US012180497B2

(12) United States Patent
Liu et al.

(10) Patent No.: US 12,180,497 B2
(45) Date of Patent: Dec. 31, 2024

(54) RESISTANCE GENES ASSOCIATED WITH DISEASE RESISTANCE IN SOYBEANS

(71) Applicant: Syngenta Crop Protection AG, Basel (CH)

(72) Inventors: Qingli Liu, Durham, NC (US); Robert Arthur Dietrich, Durham, NC (US); Thomas Joseph Curley, Jr., Durham, NC (US); Becky Welsh Breitinger, Durham, NC (US); John Daniel Hipskind, Durham, NC (US); John Luther Dawson, Durham, NC (US); Xiaoping Tan, Durham, NC (US); Andrew David Farmer, Santa Fe, NM (US)

(73) Assignee: Syngenta Crop Protection AG, Basel (CH)

( * ) Notice: Subject to any disclaimer, the term of this patent is extended or adjusted under 35 U.S.C. 154(b) by 39 days.

(21) Appl. No.: 17/631,174

(22) PCT Filed: Jul. 30, 2020

(86) PCT No.: PCT/US2020/044221

§ 371 (c)(1),
(2) Date: Jan. 28, 2022

(87) PCT Pub. No.: WO2021/022022

PCT Pub. Date: Feb. 4, 2021

(65) Prior Publication Data

US 2022/0267789 A1 Aug. 25, 2022

Related U.S. Application Data

(60) Provisional application No. 62/881,881, filed on Aug. 1, 2019.

(51) Int. Cl.

| | |
|---|---|
| ***C12N 15/82*** | (2006.01) |
| ***A01H 1/00*** | (2006.01) |
| ***A01H 1/04*** | (2006.01) |
| ***A01H 5/10*** | (2018.01) |
| ***A01H 6/54*** | (2018.01) |

(52) U.S. Cl.
CPC ......... *C12N 15/8282* (2013.01); *A01H 1/045* (2021.01); *A01H 1/1255* (2021.01); *A01H 5/10* (2013.01); *A01H 6/542* (2018.05)

(58) Field of Classification Search
None
See application file for complete search history.

(56) References Cited

U.S. PATENT DOCUMENTS

| | | | |
|---|---|---|---|
| 2009/0093620 | A1 | 4/2009 | Kovalic et al. |
| 2017/0273260 | A1 | 9/2017 | Baley et al. |
| 2018/0255733 | A1 | 9/2018 | Lee et al. |

FOREIGN PATENT DOCUMENTS

| | | |
|---|---|---|
| WO | 2019/13918 A1 | 5/2019 |

OTHER PUBLICATIONS

International Search Report for International Application No. PCT/US2020/044221 mailed Nov. 18, 2020.
Periyannan et al., "An overview of genetic rust resistance: From broad to specific mechanisms," PLoS Pathogens, Jul. 13, 2017 (Jul. 13, 2017), vol. 13, Issue 7, pp. 1-6.

*Primary Examiner* — Medina A Ibrahim
(74) *Attorney, Agent, or Firm* — Suparna Kanjilal

(57) ABSTRACT

The present invention relates to methods and compositions for identifying, selecting and/or producing a Disease resistant soybean plant or germplasm using genes derived from *Glycine canescens, Glycine clandestina, Glycine tomentella*. A soybean plant or germplasm that has been identified, selected and/or produced by any of the methods of the present invention is also provided. Disease resistant soybean seeds, plants and germplasms are also provided.

37 Claims, 16 Drawing Sheets

Specification includes a Sequence Listing.

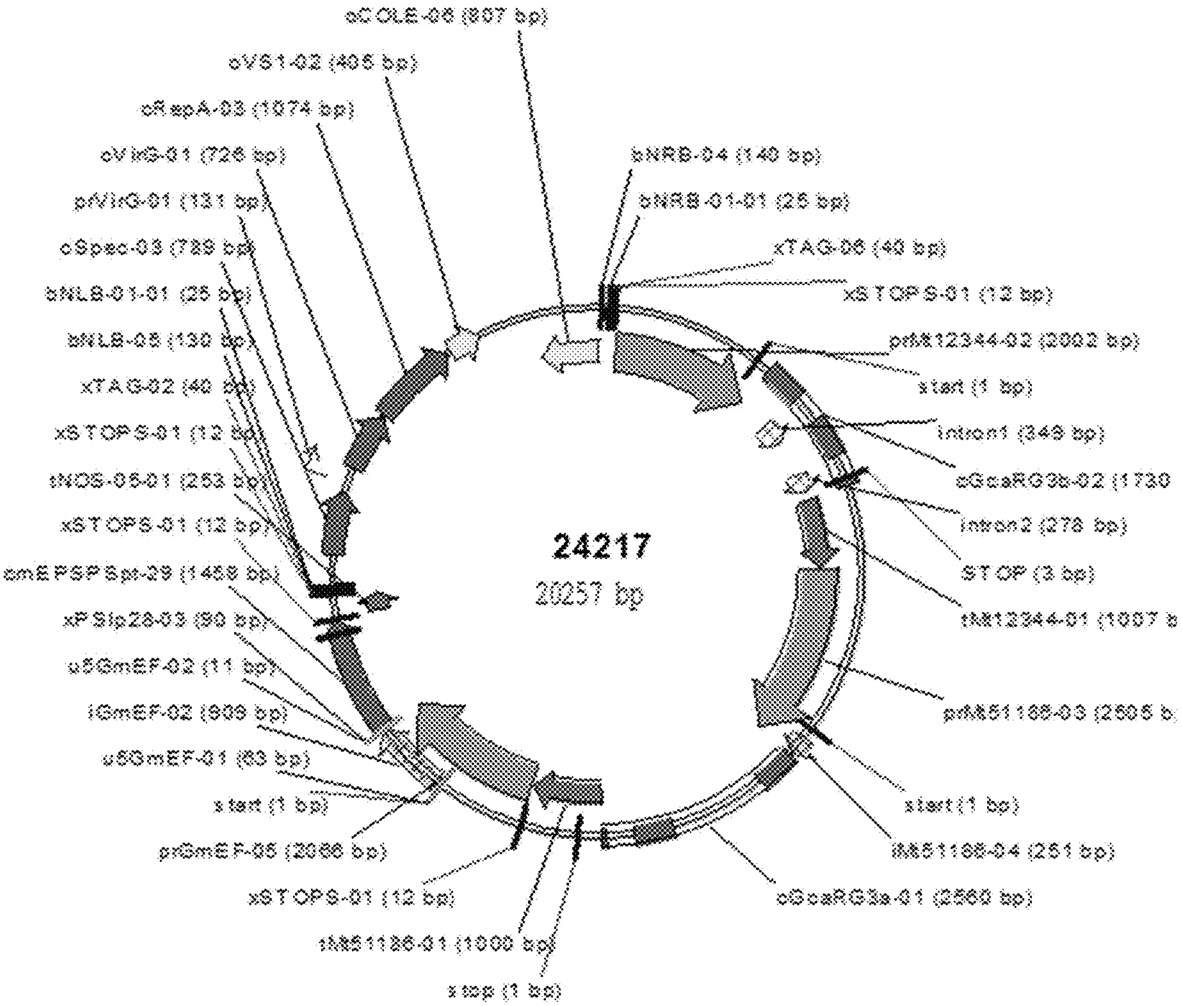
Figure 1: Illustration of binary vector 24217.

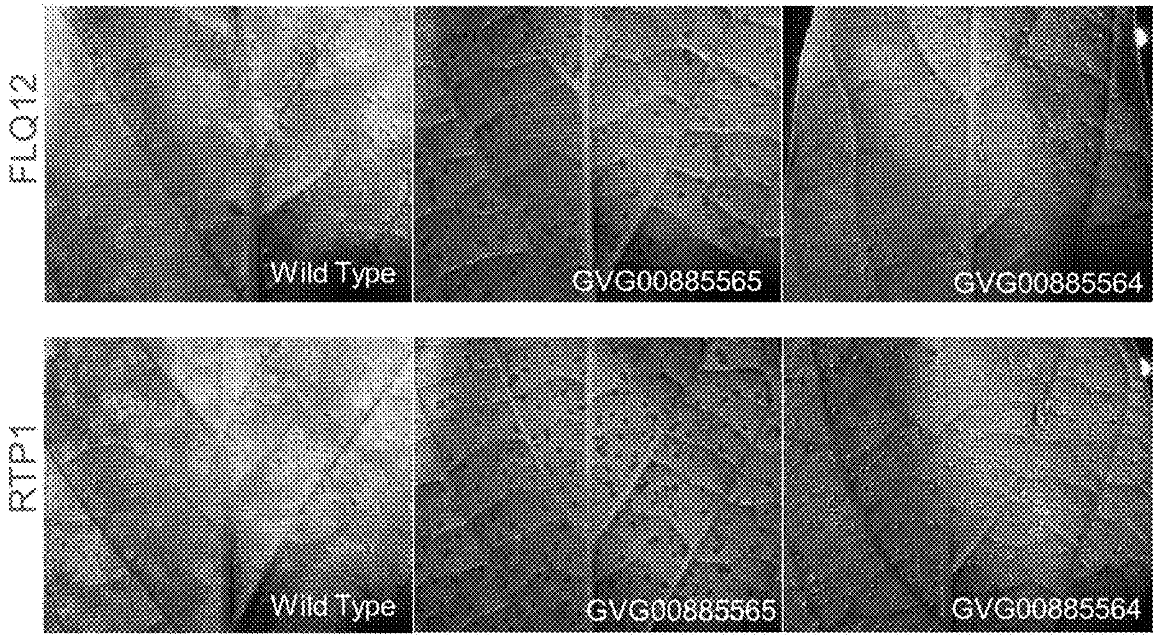
FIGURE 2. Photographs of rust bioassay experiments conducted on leaves collected from primary soybean events generated from binary vector 24217.

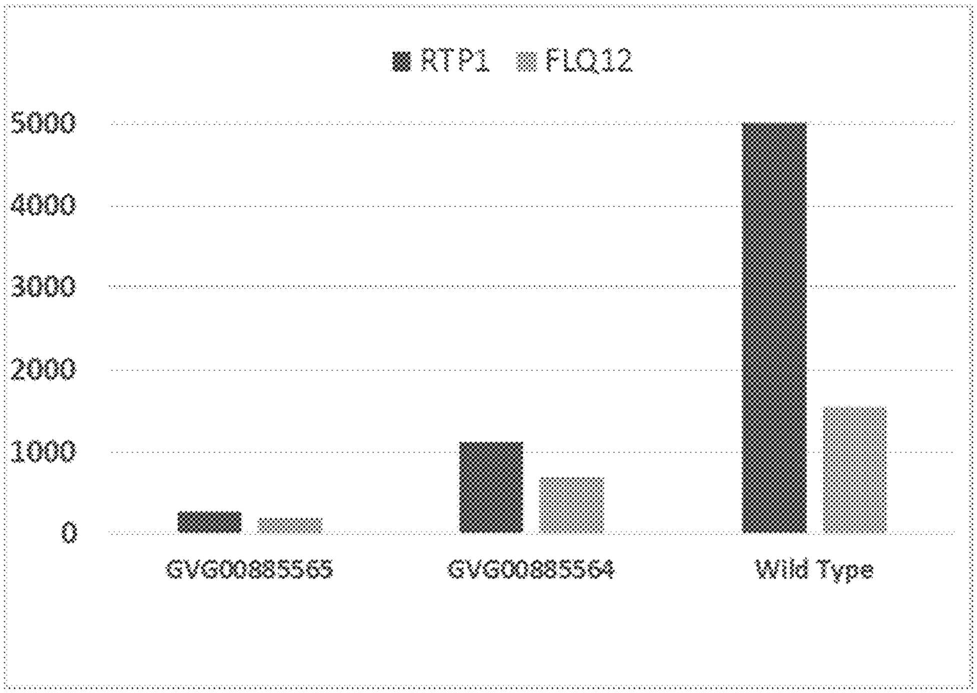
Figure 3. Relative expression (y-axis) of soybean rust β-tubulin gene in construct 24217 primary soybean events at 14 days post inoculation.

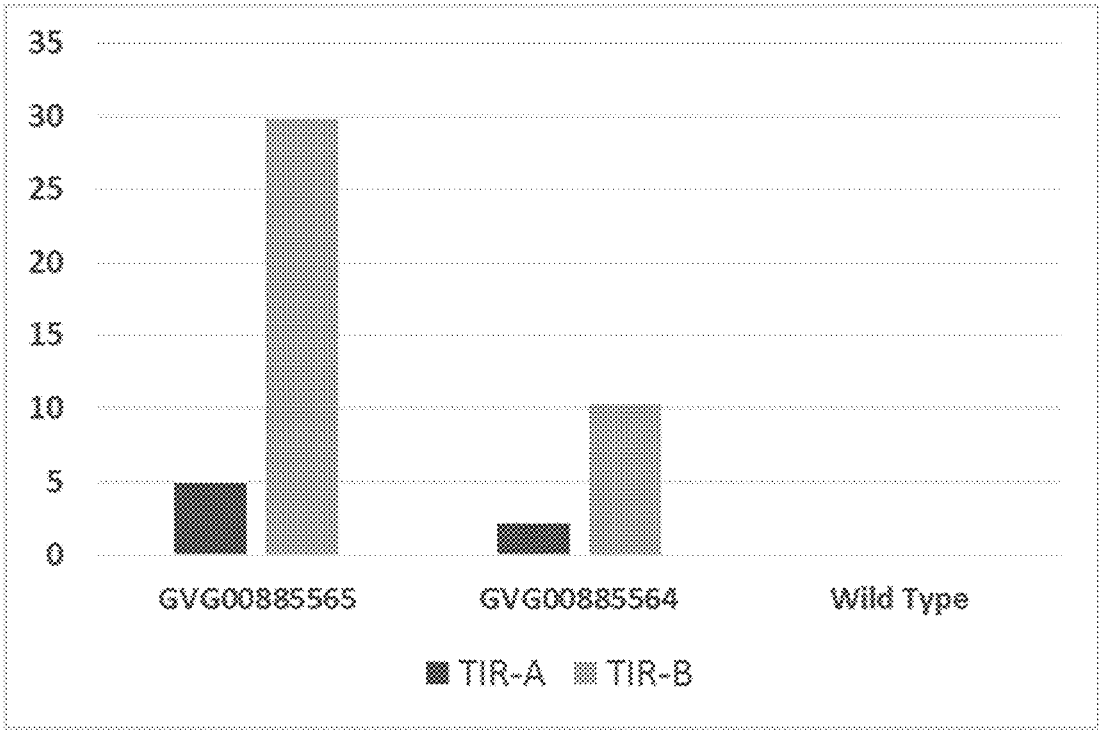
**Figure 4. Relative expression (y-axis) of *G. canescens TIR-A* and *TIR-B* genes in transgenic soybean events conferring resistance to soybean rust.**

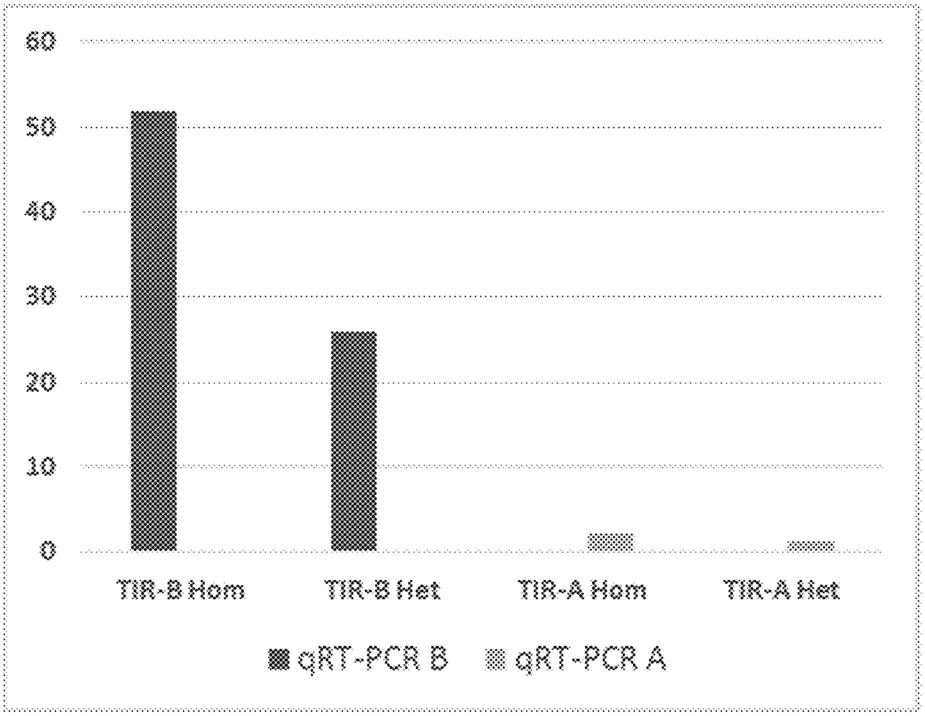
**Figure 5. Summary of qRT-PCR analysis of GVG00885565 T1 – generation plants that are homozygous or heterozygous for *TIR-A* and *TIR-B* genes.**

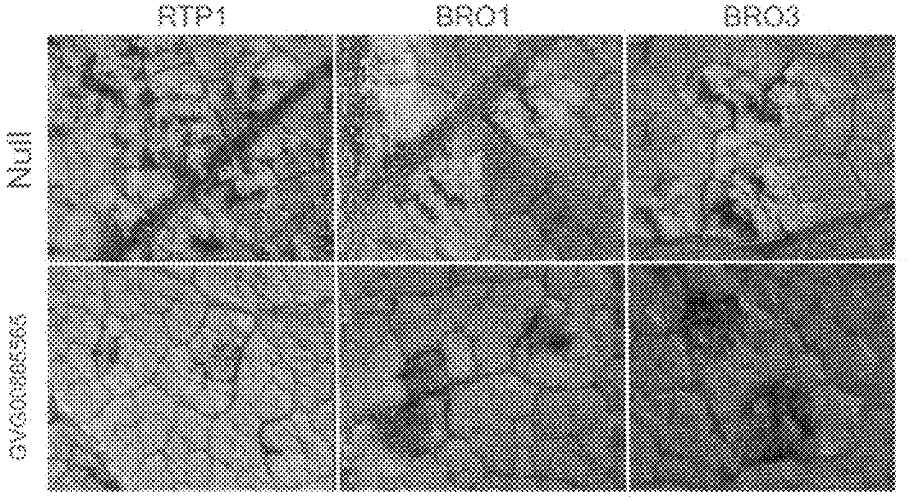
Figure 6. The T1-generation null and homozygous GVG00885565 plants 14 days post-inoculation with three different soybean rust populations. Note the high degree of rust sporulation on the leaves of null plants.

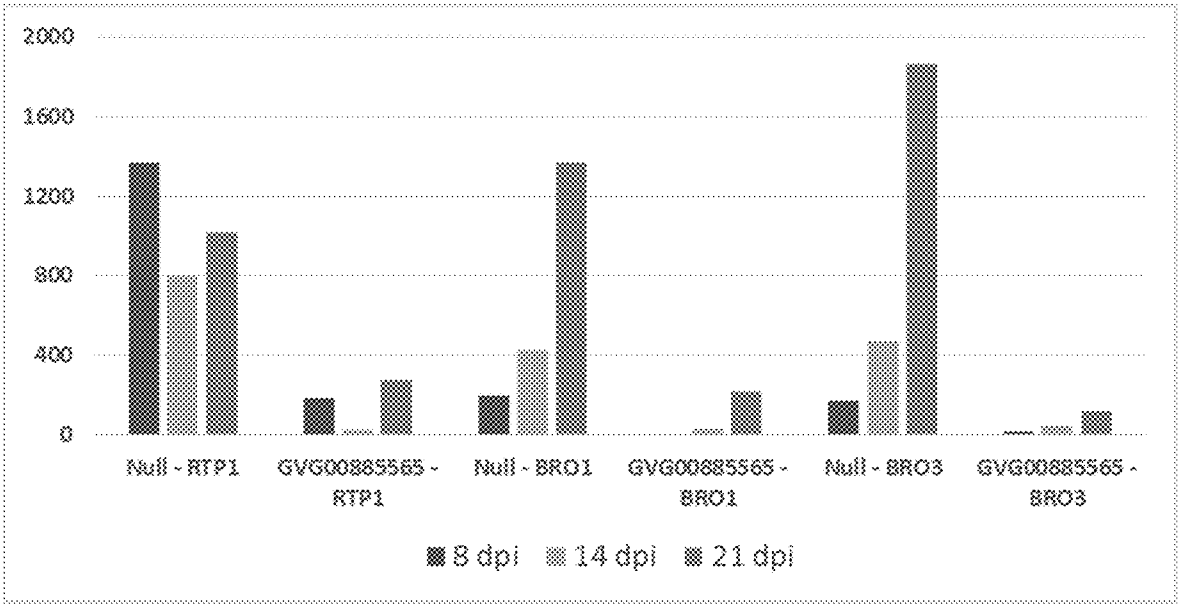
**Figure 7. The relative expression (y-axis) of soybean rust β-tubulin gene at 8, 14 and 21 days post-inoculation in the null and *TIR-A, TIR-B* homozygous plants.**

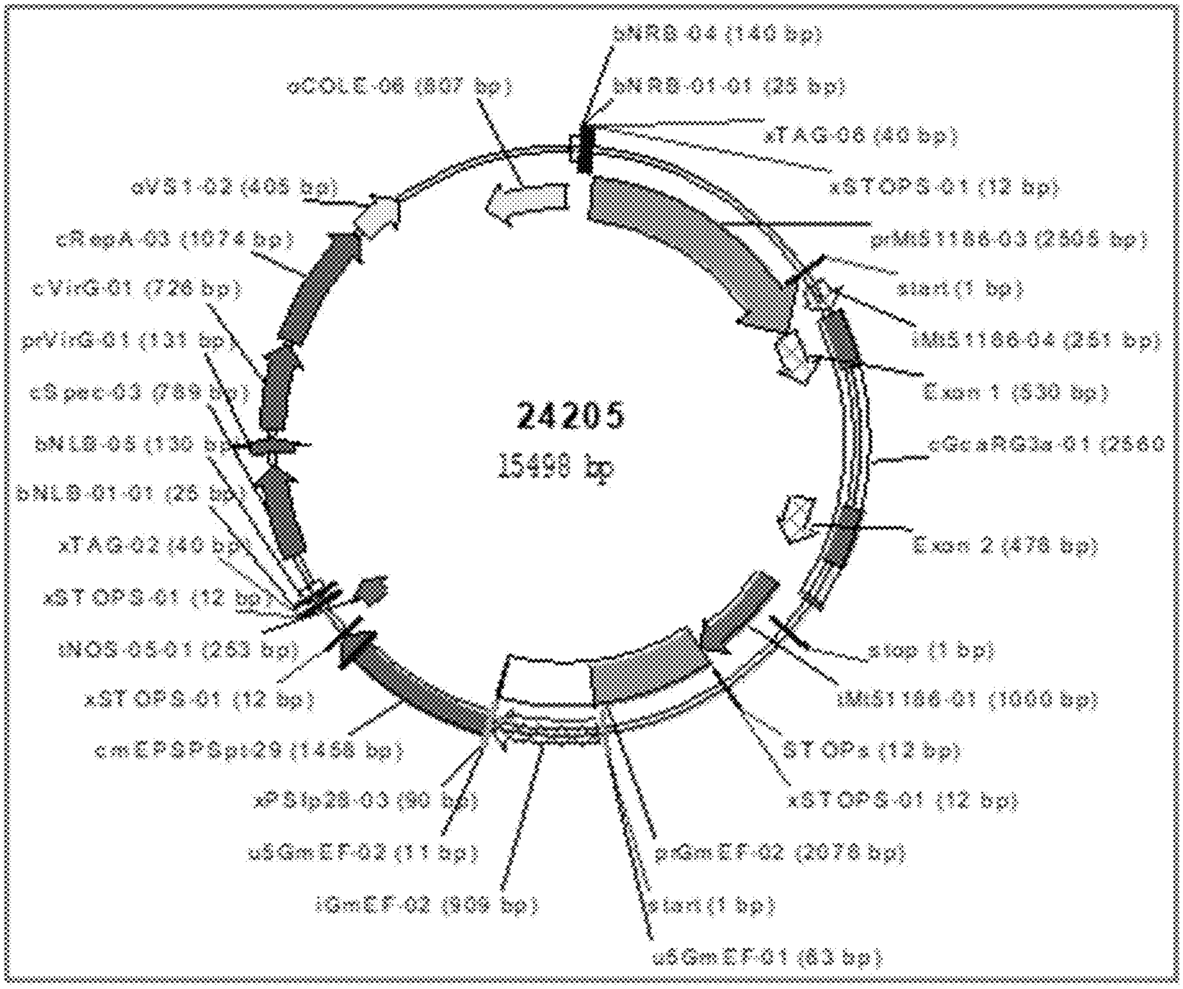
Figure 8A. Binary vector map of *TIR-A* (24205) used in co-transformation experiments.

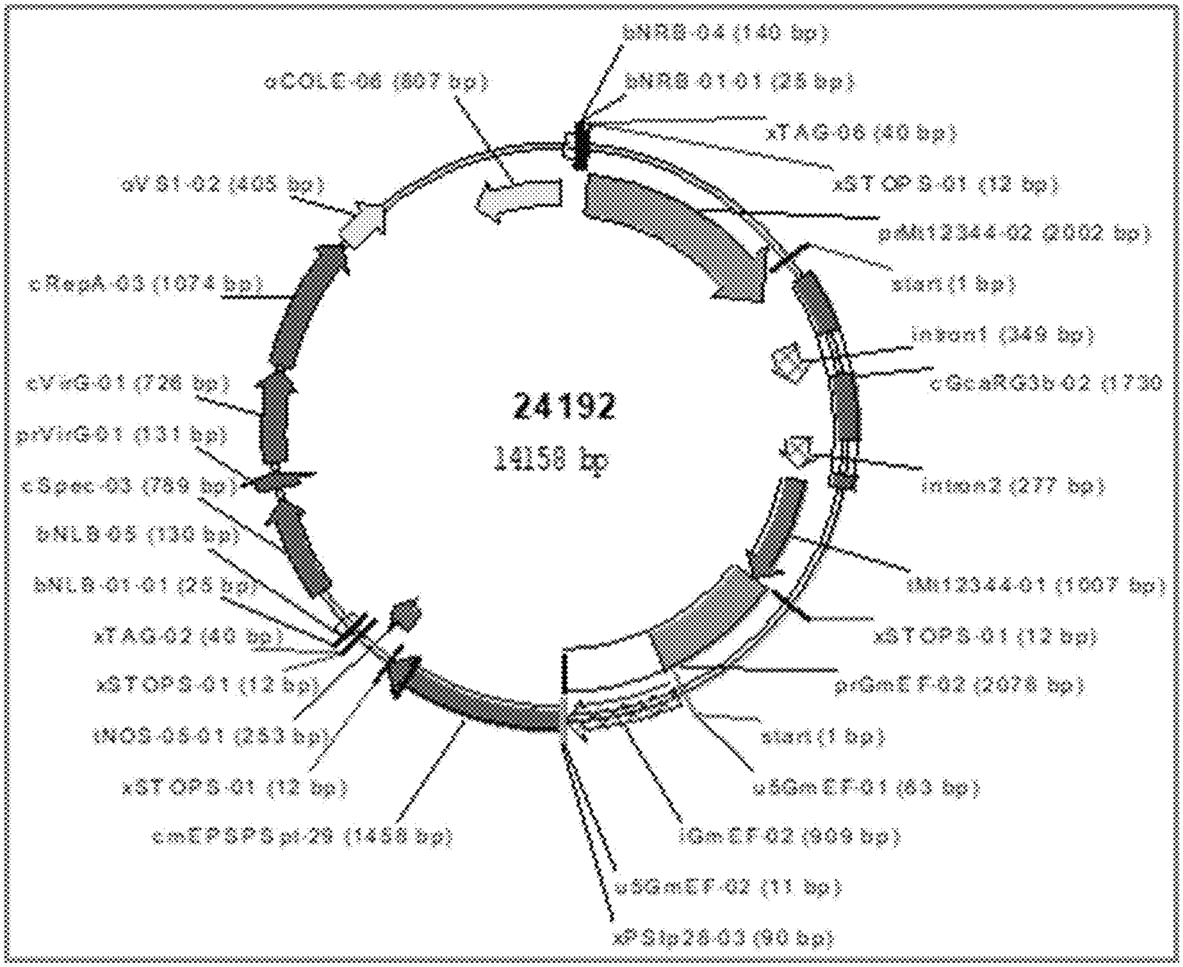
Figure 8B. **Binary vector maps of *TIR-B* (24192) used in co-transformation experiments.**

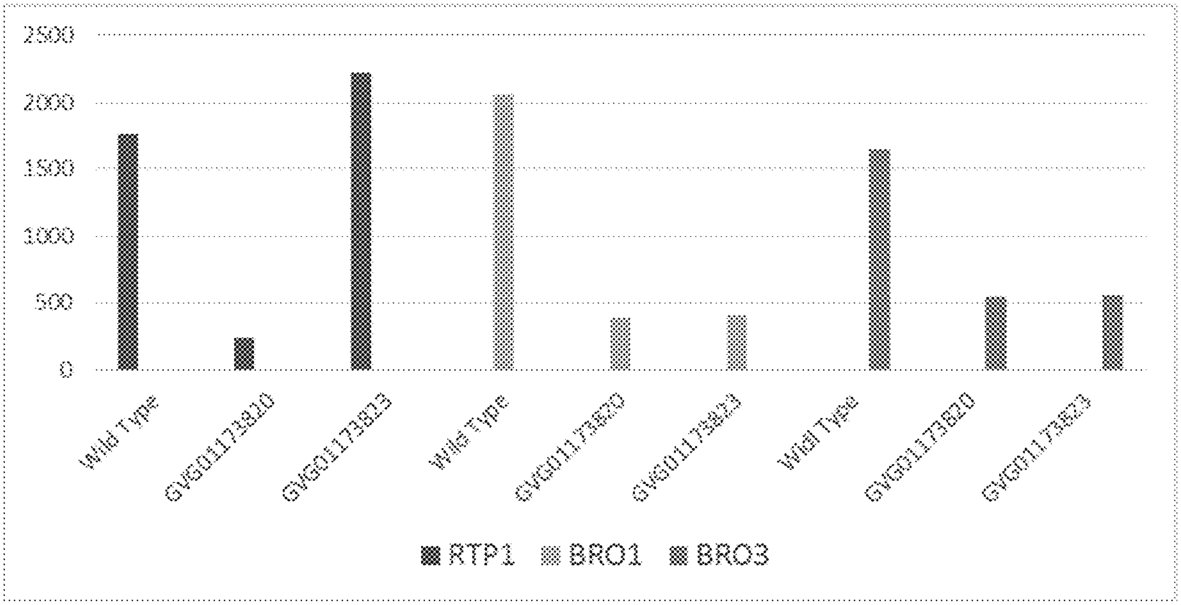
Figure 9: Summary of qRT-PCR relative expression of soybean rust β-tubulin gene expression (y-axis) from primary soybean events at 14 days post inoculation.

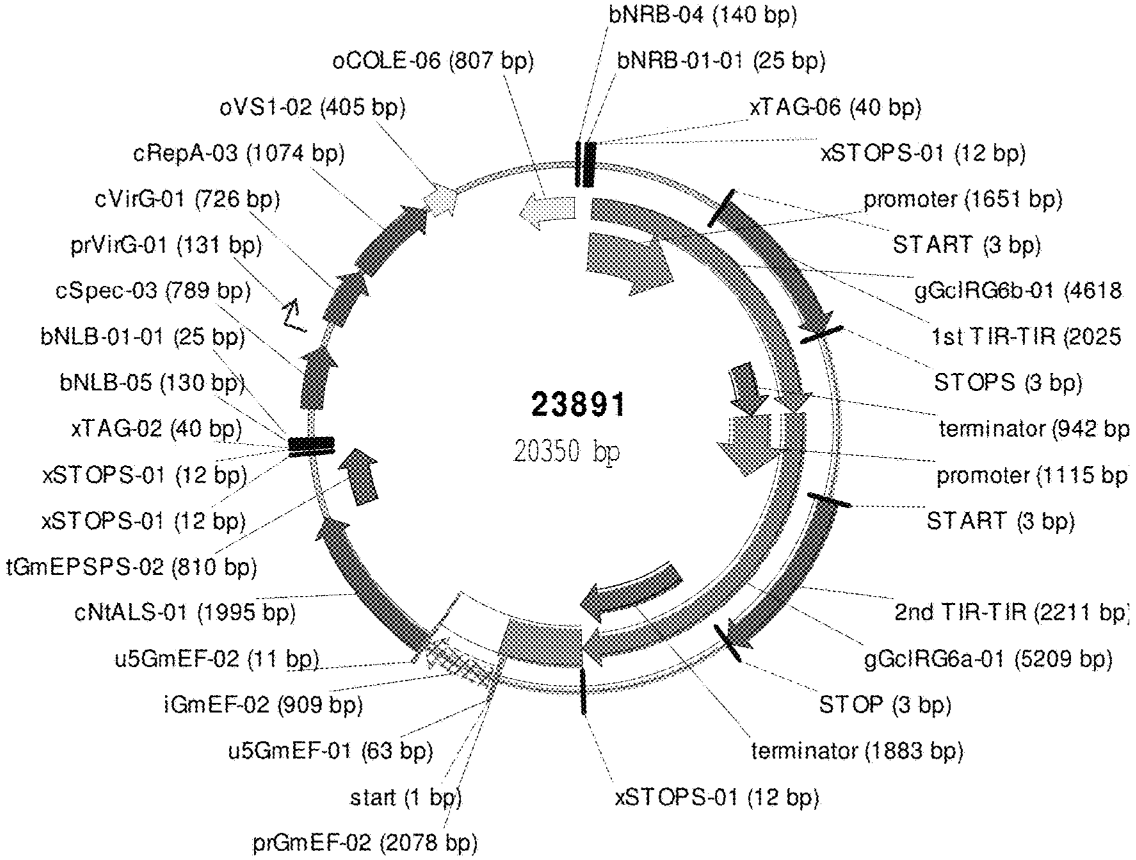
Figure 10. Illustration of binary vector 23891; G. clandestina PI339656 – TIR-A and TIR-B

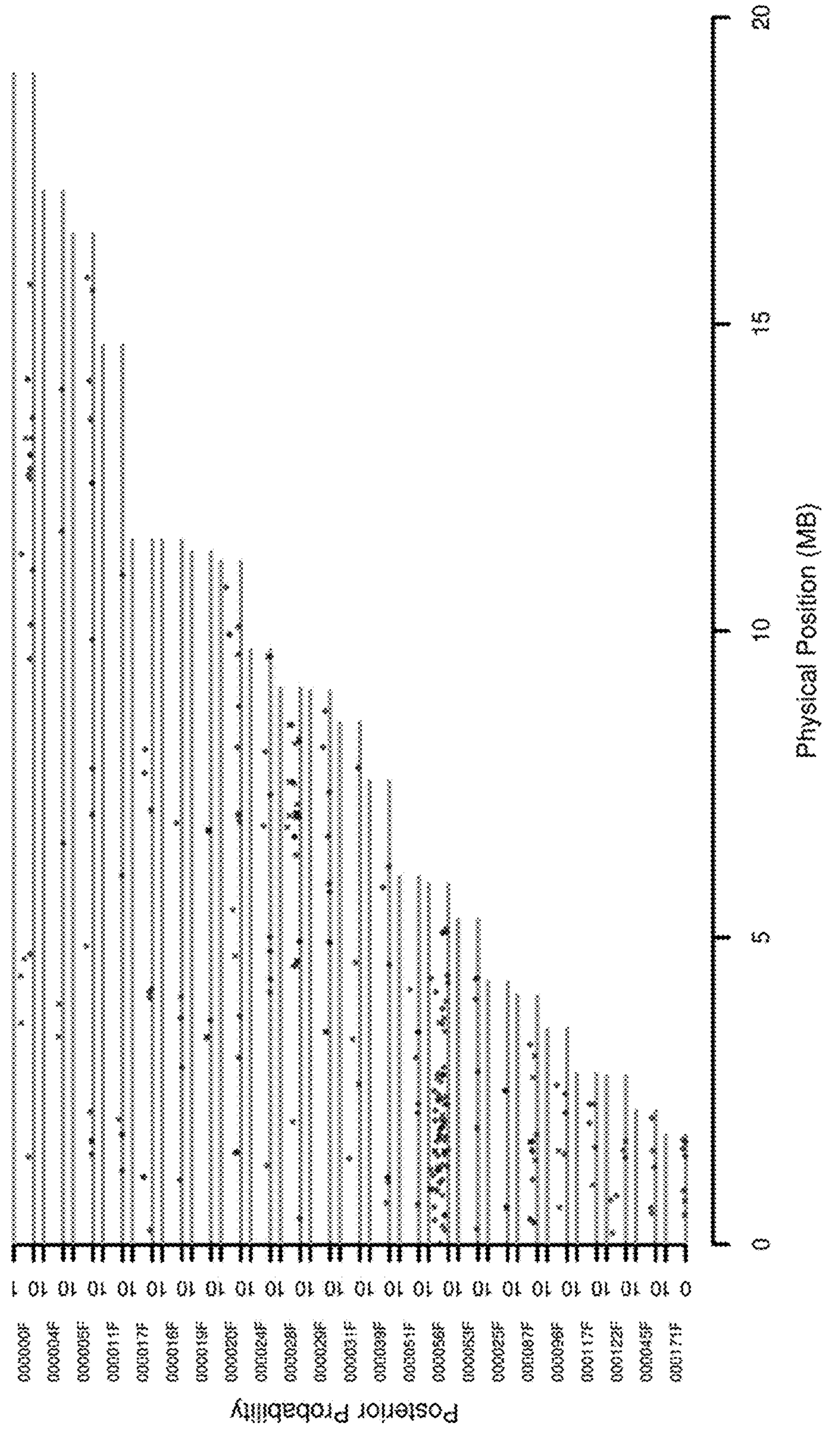
**FIG. 11: Depiction of *Glycine canescens* PI440935 SNPs Associated with ASR Resistance (i.e. each dot equals 1 SNP that associates with ASR resistanc**

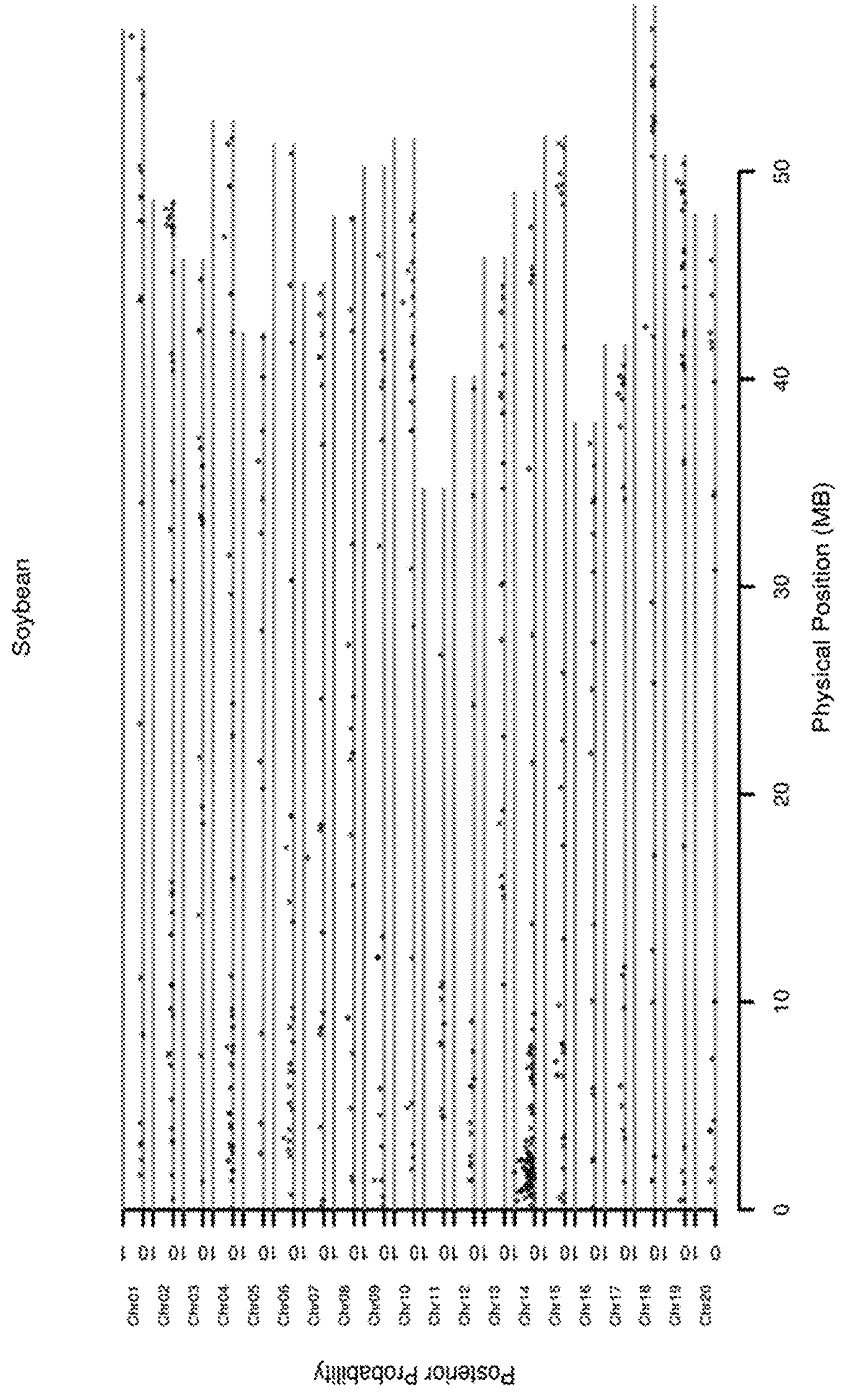
**FIG. 12: Depiction of *Glycine canescens* PI440935 SNPs Associated with ASR Resistance with chromosome number (i.e. each dot equals 1 SNP that associates with ASR resistance)**

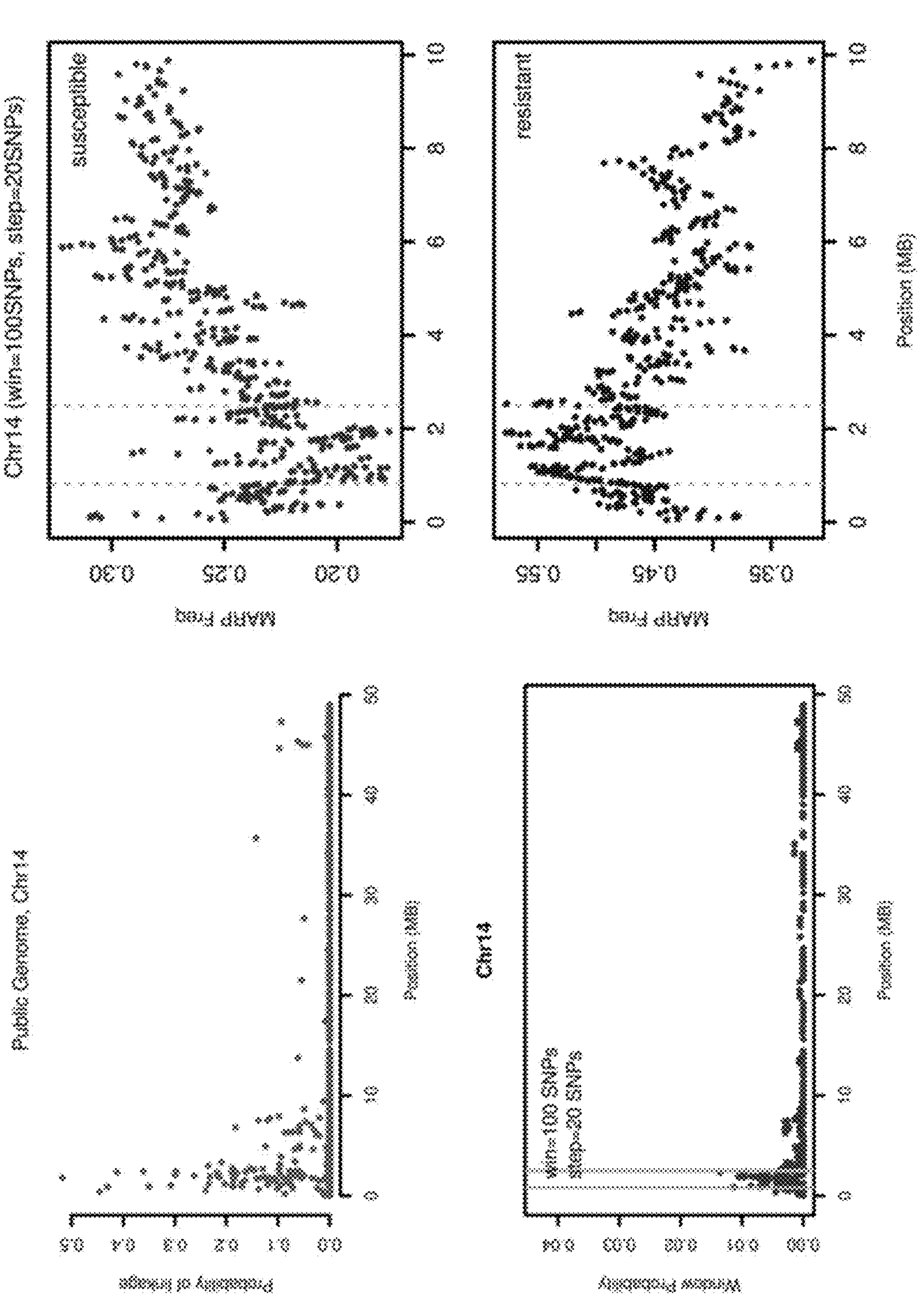
FIG. 13: Mapping Interval Discovery for Scaffold 000056F (Suggested interval Chromosome 14 0.85 – 2.5 Mb

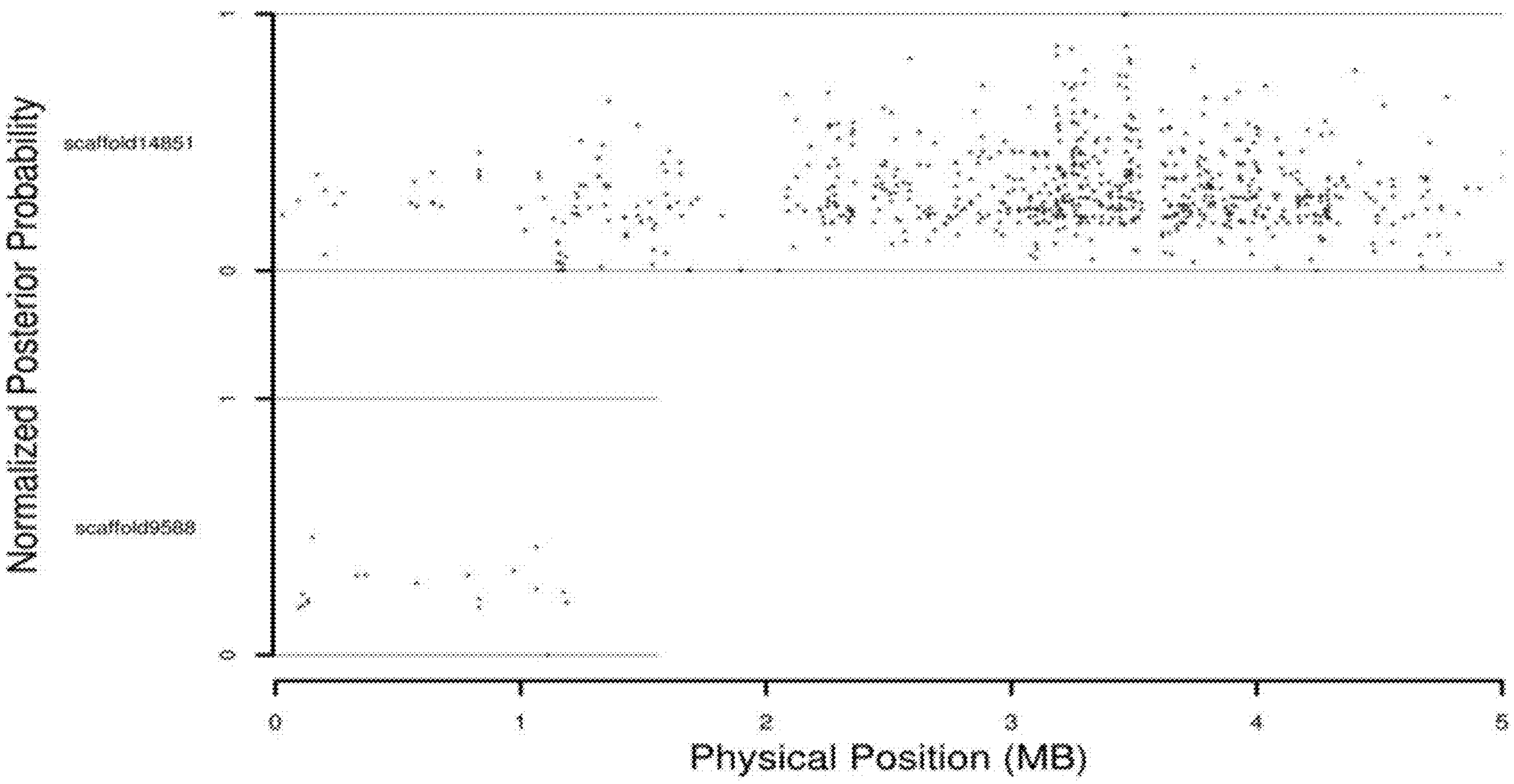
**FIG. 14: Depiction of *Glycine clandestina* PI339656 SNPs Associated with ASR Resistance (i.e. each dot equals 1 SNP that associates with ASR resistance; scaffold 14851 (Chr14) & scaffold 9588 (CHR9))**
InformativeSNPs = 10,915, Total SNPs on Top Contigs = 2,165

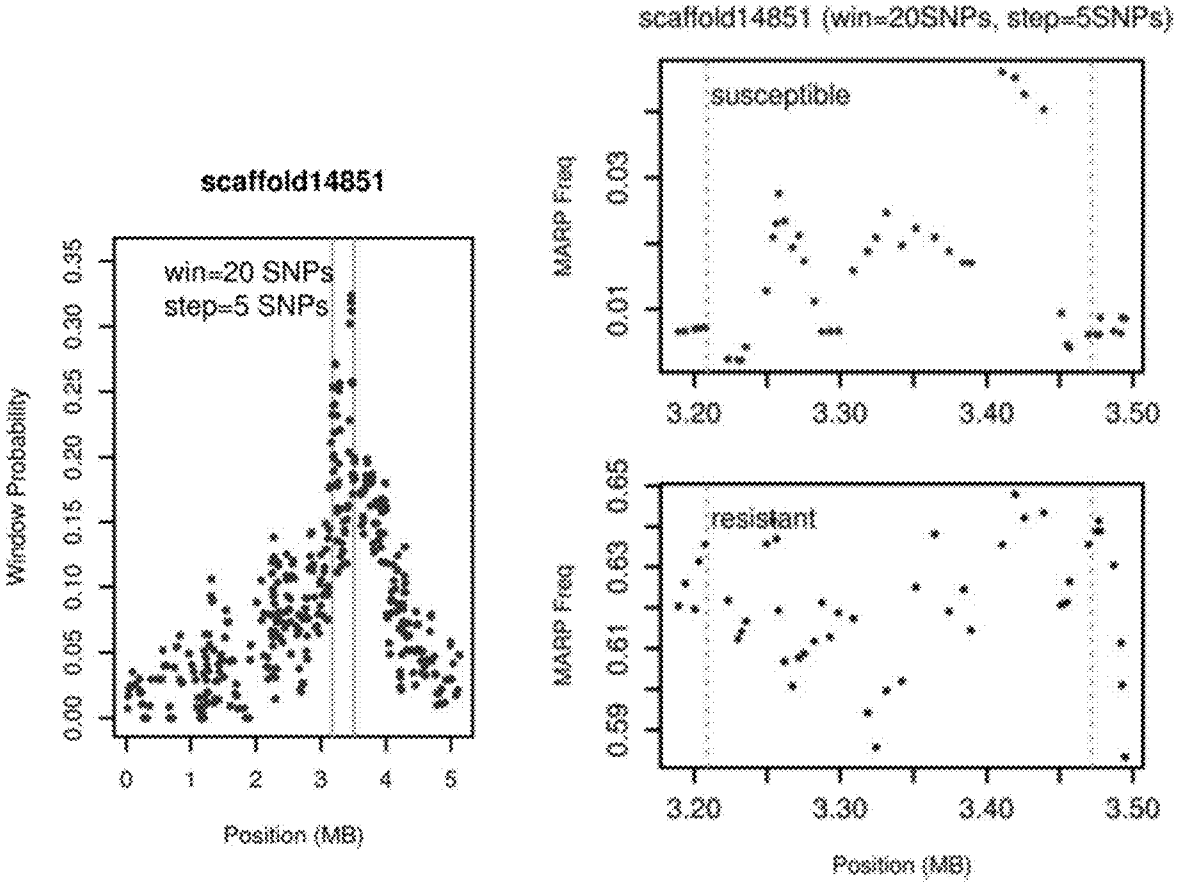
FIG. 15: Mapping Interval Discovery for Scaffold 14851 (Suggested interval Chromosome 14: 3.18-3.5Mb)

RESISTANCE GENES ASSOCIATED WITH DISEASE RESISTANCE IN SOYBEANS

RELATED APPLICATION INFORMATION

This application is a 371 of International Application No. PCT/US2020/044221, filed 30 Jul. 2020, which claims priority to 62/881,881, filed 1 Aug. 2019, the contents of which are incorporated herein by reference herein.

STATEMENT REGARDING ELECTRONIC SUBMISSION OF A SEQUENCE LISTING

A Sequence Listing in ASCII text format, submitted under 37 C.F.R. § 1.821, entitled "81819-US-REG-ORG-P-1-SequenceList_ST25.txt", 24.0 MB (25,265,401 bytes) in size, generated on Aug. 1, 2019 and filed via EFS-Web is provided in lieu of a paper copy. This Sequence Listing is hereby incorporated by reference into the specification for its disclosures.

FIELD OF THE INVENTION

The present invention relates to compositions and methods for identifying, selecting and producing enhanced disease and/or pathogen resistant plants using novel resistance genes.

STATEMENT REGARDING ELECTRONIC SUBMISSION OF A SEQUENCE LISTING

A Sequence Listing in ASCII text format, submitted under 37 C.F.R. § 1.821, entitled "81819-WO-REG-ORG-P-1-SequenceList_ST25" generated on 1 Aug. 2019 and filed via EFS-Web is provided in lieu of a paper copy. This Sequence Listing is hereby incorporated by reference into the specification for its disclosures.

BACKGROUND

Plant pathogens are known to cause considerable damage to important crops, resulting in significant agricultural losses with widespread consequences for both the food supply and other industries that rely on plant materials. As such, applicant desires to reduce the incidence and/or impact of agricultural pathogens on crop production.

Several pathogens have been associated with damage to soybeans, which individually and collectively have the potential to cause significant yield losses in the United States and throughout the world. Exemplary pathogens include, but are not limited to fungi (e.g., genus *Phytophthora* and Asian Soybean rust *Phakopsora pachyrhizi*), nematodes (e.g., genus *Meloidogyne*, particularly, *Meloidogyne javanica*), and soybean stem canker. Given the significant threat to global food supplies that these pathogens present as well as the time and expense associated with treating soybean crops to prevent yield loss, new methods for producing pathogen resistant soybean cultivars are needed. What is needed is novel resistance genes (herein, "R-Genes") that can be introduced into commercial soybean plants to control soybean pathogens.

SUMMARY OF THE INVENTION

This summary lists several embodiments of the presently disclosed subject matter, including variations of these embodiments.

Compositions and methods for identifying, selecting and producing *Glycine* plants (including wild Glycines (e.g. *Glycine canescens, Glycine clandestina, Glycine tomentella*), elite *Glycine* lines and *Glycine max* lines) with enhanced disease resistance are provided. Disease resistant soybean plants and germplasms are also provided. In some embodiments, methods of producing a disease resistant soybean plant are provided.

In one aspect of the invention there is provided a DNA construct that comprises a promoter that functions in plant cells operably linked to a novel resistance gene (herein an R-Gene). In another aspect of the invention there is provided a transgenic plant that contains the DNA construct and has increased expression of the R-gene, wherein the transgenic plant is resistant to soybean pathogens, particularly Asian Soybean Rust.

In another aspect of the invention is a method of preparing a fertile transgenic plant comprising providing a plant expression cassette comprising an R-Gene and contacting recipient plant cells with the plant expression cassette under conditions permitting the uptake of the plant expression cassette by the recipient cells; selecting the recipient plant cells that contain the plant expression cassette; regenerating plants from the selected recipient plant cells; and identifying a fertile transgenic plant that is resistant to soybean pathogens, particularly Asian Soybean Rust (herein "ASR").

In another aspect of the invention there is provided a fertile transgenic plant that comprises a plant expression cassette comprising an R-Gene, wherein the plant has increased expression levels of the R-gene, and wherein the plant is resistant to soybean pathogens, particularly Asian Soybean Rust. In one aspect of the invention, the plant is an elite soybean plant that is resistant to soybean pathogens.

In another aspect of the invention there is provided a method of controlling ASR in a field comprising the step of planting the seed from a plant comprising an R-gene of the invention.

Thus, it is an object of the presently disclosed subject matter to provide methods for conveying pathogen resistance into non-resistant soybean germplasm or plant lines.

Further the presently disclosed subject matter provides novel *Glycine max* lines comprising in its genome a R-gene that is derived from a wild glycine species, e.g. *Glycine canescens* or *Glycine clandestina* or *Glycine tomentella*, and further confers ASR resistance in the novel *Glycine max* line. Soybean plants and/or germplasms identified, produced or selected by the methods of this invention are also provided, as are any progeny and/or seeds derived from a soybean plant or germplasm identified, produced or selected by these methods.

As still a further aspect, the invention encompasses transgenic plants comprising a plant cell, plant part, nucleotide sequence, expression cassette, vector and/or R-genes of the invention.

As a further aspect are seeds that produce the transgenic plants of the invention and seeds produced by the transgenic plants of the invention.

Also provided are harvested products derived from the transgenic plants of the invention, wherein the harvested product optionally comprises a nucleotide sequence, expression cassette, vector and/or R-gene of the invention. Further provided are processed products derived from the harvested products of the invention, wherein the harvested product optionally comprises a nucleotide sequence, expression cassette, vector and/or R-gene of the invention.

Still further, the invention provides as an additional aspect a method of producing a transgenic plant with increased resistance to a soybean pathogen. In embodiments, the method comprises introducing into a plant a polynucleotide, expression cassette, or vector of the invention, wherein the R-gene is expressed in the plant, thereby producing a transgenic plant with increased resistance to a soybean pathogen. Optionally, the introducing step comprises: (i) transforming a plant cell with the polynucleotide, expression cassette or vector and regenerating a transgenic plant; or (ii) crossing a first plant comprising the polynucleotide, expression cassette or vector with a second plant. In embodiments, the method further comprises producing a seed from the transgenic plant. In embodiments, the method further comprises obtaining a progeny plant from the transgenic plant, wherein the progeny plant comprises the polynucleotide, the expression cassette or the vector, expresses the R-gene and has increased resistance to a soybean pathogen.

As yet another aspect, the invention provides a method of producing a transgenic plant with increased resistance to a soybean plant pathogen (e.g., Asian Soybean Rust), the method comprising: (a) planting a seed comprising a polynucleotide, expression cassette or vector of the invention; and (b) growing a transgenic plant from the seed, wherein the transgenic plant comprises the polynucleotide, expression cassette or vector and produces the R-gene and has increased resistance to a soybean pathogen. In embodiments, the method further comprises: (c) harvesting a seed from the transgenic plant of (b), wherein the harvested seed comprises the polynucleotide, expression cassette, vector and/or the R-gene.

Still further, as another aspect, the invention provides a method of producing a seed. In embodiments, the method comprises: (a) providing a transgenic plant that comprises a polynucleotide, expression cassette or vector of the invention; and (b) harvesting a seed from the transgenic plant of (a), wherein the harvested seed comprises the polynucleotide, expression cassette or vector and/or a R-gene of the invention.

The invention further contemplates a method of producing a hybrid plant seed. In representative embodiments, the method comprises: (a) crossing a first inbred plant, which is a transgenic plant comprising a polynucleotide, expression cassette or vector of the invention with a second, different inbred plant, which may or may not comprise the polynucleotide, expression cassette or vector of the invention; and (b) harvesting hybrid seed from a progeny plant.

The invention is also drawn to methods of using the polynucleotides of the invention, for example, in DNA constructs or expression cassettes or vectors for transformation and expression in organisms, including plants. The nucleotide or amino acid sequences may be native or synthetic sequences that have been designed for expression in an organism such as a plant.

In embodiments, the invention provides a method of using a polynucleotide, expression cassette or vector of the invention to produce a transgenic seed, where the transgenic seed grows a transgenic plant with increased resistance to a soybean pathogen.

The foregoing and other objects and aspects of the present invention are explained in detail in the drawings and specification set forth below.

BRIEF DESCRIPTION OF THE DRAWINGS

FIG. 1 is an Illustration of binary vector 24217.

FIG. 2 shows photographs of rust bioassay experiments conducted on leaves collected from primary soybean events generated from binary vector 24217.

FIG. 3 is a graph showing relative expression (y-axis) of soybean rust β-tubulin gene in construct 24217 primary soybean events at 14 days post inoculation.

FIG. 4 is a graph showing relative expression (y-axis) of *G. canescens* TIR-A and TIR-B genes in transgenic soybean events conferring resistance to soybean rust.

FIG. 5 is graph summarizing qRT-PCR analysis of GVG00885565 T1-generation plants that are homozygous or heterozygous for TIR-A and TIR-B genes.

FIG. 6 shows photographs of T1-generation null and homozygous GVG00885565 plants 14 days post-inoculation with three different soybean rust populations.

FIG. 7 is a graph summarizing the relative expression (y-axis) of soybean rust β-tubulin gene at 8, 14 and 21 days post-inoculation in the null and TIR-A, TIR-B homozygous plants.

FIG. 8A is an illustration of a binary vector map of TIR-A (24205) used in co-transformation experiments.

FIG. 8B is an illustration of a binary vector map of TIR-B (24192) used in co-transformation experiments.

FIG. 9. Foliar symptoms correlating to qRT assay.

FIG. 10 is an illustration of binary vector 23891.

FIG. 11 is a depiction of *Glycine canescens* PI440935 SNPs associated with ASR Resistance (i.e. each dot equals 1 SNP that associates with ASR resistance).

FIG. 12 is a depiction of *Glycine canescens* PI440935 SNPs associated with ASR Resistance with chromosome number (i.e. each dot equals 1 SNP that associates with ASR resistance).

FIG. 13 shows SNP charts related to mapping intervals for Scaffold 000056F.

FIG. 14 depicts *Glycine clandestina* PI339656 SNPs associated with ASR Resistance (i.e. each dot equals 1 SNP that associates with ASR resistance; scaffold 14851 (Chr14) & scaffold 9588 (CHR9).

FIG. 15 shows SNP charts related to mapping intervals for Scaffold 14851.

BRIEF DESCRIPTION OF THE SEQUENCE LISTING

SEQ ID NO: 1 is a chromosomal interval derived from *Glycine canescens* line accession PI440935 referred to herein as “Scaffold 000056F. Scaffold 000056F has been mapped to *G. canescens* chromosome 14. SEQ ID NO. 2 is a chromosomal interval derived from *Glycine canescens* line accessions PI595799 referred to herein as “Scaffold 000090F”. Scaffold 000090F has been mapped to *G. canescens* chromosome 14. SEQ ID NO: 3 is a chromosomal interval derived from *Glycine canescens* line accession PI 483193 referred to herein as “Scaffold 92F”. Scaffold 132F has been mapped to *G. canescens* chromosome 14. SEQ ID NO: 4 is a chromosomal intervals derived from *Glycine clandestina* line accession PI339656 referred to herein as “Scaffold 14851”. Scaffold 14851 has been mapped to *G. clandestina* chromosome 14 at an approximate interval of 3.18 to 3.50 MB on Scaffold 14851. These chromosomal intervals or portions thereof may be introduced (i.e. introgressed through use of embryo rescue and/or marker assisted breeding (MAB)) into *Glycine max* lines to create *Glycine max* lines resistant to disease (e.g. Asian Soybean Rust (ASR)). SEQ ID NO: 5 is a chromosomal intervals derived from *Glycine tomentella* line accession PI509501 referred to herein as “Scaffold 4269. SEQ ID NO: 6 is a chromosomal intervals derived from *Glycine tomentella* line accession PI509501 referred to herein as "Scaffold 1509". Scaffolds 4269 and 1509 have been mapped to *G. tomentella* chromosome 14.

Further research into the intervals led to the discovery of causative genes and associated native promoters and terminator sequences were identified from the above interval(s) located on or corresponding to *G. canescens* and *G. clandestina* Chromosome 14.

SEQ ID NO: 7 is genomic DNA for a soy rust resistance gene (also referred to herein as the "TIR-A gene") from PI595799 encoding a protein containing Toll/Interleukin-1 receptor (a "TIR" R-gene motif) domain synthetic to Glyma.05G165800 (Soy_william82_v2). SEQ ID NO: 8 is a cDNA sequence for the TIR-A gene. SEQ ID NO: 9 comprises an exemplary promoter for either of SEQ ID NOs: 7 or 8. SEQ ID NO: 9 comprises and an exemplary terminator sequence for either of SEQ ID NOs: 7 or 8. SEQ ID NOs: 7 and 8 encodes the protein of SEQ ID NO: 11.

SEQ ID NO: 12 is genomic DNA for another soy rust resistance gene (also referred to herein as the TIR-B gene") having a TIR R-gene motif. SEQ ID NO: 13 is a cDNA sequence for the TIR-B gene. SEQ ID NO: 14 comprises an exemplary promoter for either of SEQ ID NOs: 12 or 13. SEQ ID NO: 15 comprises and an exemplary terminator sequence for either of SEQ ID NOs: 12 or 13. SEQ ID NOs: 12 or 13 encode the protein of SEQ ID NO: 16.

ASR resistance can be introduced into *G. max* plants using SEQ ID NOs: 7, 8, 11, 12 or any combination there. It is further contemplated that ASR resistance can be introduced into elite Soybean plants either via transgenic expression of genes encoding a protein having a TIR R-gene motif or a gene having between 70-100% homology to any of SEQ ID NOs: 7, 8, 11, 12.

SEQ ID NO: 17 is a DNA sequence for Vector 24217_*G. canescens* PI595799-cGcaRG3b-02 which is a N-terminal truncated version of TIR-B component.

SEQ ID NO: 18 is a DNA sequence for Vector 23819_*G. clandestina* PI339656-Genomic TIR-A and TIR-B.

SEQ ID NO: 19 is a DNA sequence for promoter AtEF1aA1, which is derived from the *Arabidopsis thaliana* Elongation Factor EF-1 alpha A1 gene.

SEQ ID NO: 20 is a DNA sequence for prUBQ3, which is a modified version of *Arabidopsis* Ubiquitin 3 promoter.

SEQ ID NO: 21 is a DNA sequence for prGmUbi1, which is a Ubiquitin 1 promoter from soybean.

SEQ ID NO: 22 is a DNA sequence from prLuFIS1, which is a 660 bp fragment of the first promoter from flax (*Linum usitatissimum*).

SEQ ID NO: 23 is the DNA sequence for a primer for TIR-B.

SEQ ID NO: 24 is the DNA sequence for a primer for TIR-B.

SEQ ID NO: 25 is the DNA sequence for a probe for TIR-B.

SEQ ID NO: 26 is the DNA sequence for a primer for TIR-A.

SEQ ID NO: 27 is the DNA sequence for a primer for TIR-A.

SEQ ID NO: 28 is the DNA sequence for a probe for TIR-A.

SEQ ID NO: 29 is the DNA sequence for a primer for TIR-A.

SEQ ID NO: 30 is the DNA sequence for a primer for TIR-A.

SEQ ID NO: 31 is the DNA sequence for a probe for TIR-A.

SEQ ID NO: 32 is the DNA sequence for Vector 24205.

SED ID NO: 33 is the DNA sequence for Vector 24192.

DETAILED DESCRIPTION OF THE INVENTION

The presently disclosed subject matter relates to compositions and methods for introducing novel resistance genes (herein, "R-Genes") into commercial soybean plants to control soybean pathogens. The methods involve transforming organisms with nucleotide sequences encoding the R-genes of the invention. The nucleotide sequences of the invention are useful for generating plants that show increased resistance to soybean pathogens, particularly Asian Soybean Rust (herein, "ASR"). Thus, transformed plants, plant cells, plant tissues and seeds are provided. Compositions include nucleic acids and proteins relating to soybean pathogen resistant plants as well as transformed plants, plant tissues and seeds. Nucleotide sequences of the R-genes and the amino acid sequences of the proteins encoded thereby are disclosed. The sequences find use in the construction of expression vectors for subsequent transformation into plants of interest, as probes for the isolation of other R-genes, and the like.

It is possible to produce soybean pathogen resistant plants by inserting into the plant genome a DNA molecule that provides for resistance (Cook et al, 2012 for SCN resistance; Kawashima et al., 2016 for soy rust resistance from pigeon pea).

This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

All references listed below, as well as all references cited in the instant disclosure, including but not limited to all patents, patent applications and publications thereof, scientific journal articles, and database entries (e.g., GENBANK® database entries and all annotations available therein) are incorporated herein by reference in their entireties to the extent that they supplement, explain, provide a background for, or teach methodology, techniques, and/or compositions employed herein.

Nucleotide sequences provided herein are presented in the 5' to 3' direction, from left to right and are presented using the standard code for representing nucleotide bases as set forth in 37 CFR §§ 1.821-1.825 and the World Intellectual Property Organization (WIPO) Standard ST.25, for example: adenine (A), cytosine (C), thymine (T), and guanine (G).

Amino acids are likewise indicated using the WIPO Standard ST.25, for example: alanine (Ala; A), arginine (Arg; R), asparagine (Asn; N), aspartic acid (Asp; D), cysteine (Cys; C), glutamine (Gln; Q), glutamic acid (Glu; E), glycine (Gly; G), histidine (His; H), isoleucine (Ile; 1), leucine (Leu; L), lysine (Lys; K), methionine (Met; M), phenylalanine (Phe; F), proline (Pro; P), serine (Ser; S), threonine (Thr; T), tryptophan (Trp; W), tyrosine (Tyr; Y), and valine (Val; V).

Definitions

Unless defined otherwise, all technical and scientific terms used herein have the same meaning as commonly understood to one of ordinary skill in the art to which the presently disclosed subject matter belongs.

Although the following terms are believed to be well understood by one of ordinary skill in the art, the following definitions are set forth to facilitate understanding of the presently disclosed subject matter.

As used in the description of the invention and the appended claims, the singular forms "a," "an" and "the" are intended to include the plural forms as well, unless the context clearly indicates otherwise.

As used herein, "and/or" refers to and encompasses any and all possible combinations of one or more of the associated listed items, as well as the lack of combinations when interpreted in the alternative ("or").

The term "about," as used herein when referring to a measurable value such as a dosage or time period and the like, is meant to encompass variations of ±20%, ±10%, ±5%, ±1%, ±0.5%, or even ±0.1% of the specified amount. As used herein, phrases such as "between about X and Y" mean "between about X and about Y" and phrases such as "from about X to Y" mean "from about X to about Y."

As used herein, phrases such as "between about X and Y", "between about X and about Y", "from X to Y" and "from about X to about Y" (and similar phrases) should be interpreted to include X and Y, unless the context indicates otherwise.

A "coding sequence" is a nucleic acid sequence that is transcribed into RNA such as mRNA, rRNA, tRNA, snRNA, sense RNA or antisense RNA. In embodiments, the RNA is then translated to produce a protein.

As used herein, a "codon optimized" nucleotide sequence means a nucleotide sequence of a recombinant, transgenic, or synthetic polynucleotide wherein the codons are chosen to reflect the particular codon bias that a host cell or organism may have. This is typically done in such a way so as to preserve the amino acid sequence of the polypeptide encoded by the codon optimized nucleotide sequence. In certain embodiments, a nucleotide sequence is codon optimized for the cell (e.g., an animal, plant, fungal or bacterial cell) in which the construct is to be expressed. For example, a construct to be expressed in a plant cell can have all or parts of its sequence codon optimized for expression in a plant. See, for example, U.S. Pat. No. 6,121,014. In embodiments, the polynucleotides of the invention are codon-optimized for expression in a plant cell (e.g., a dicot cell or a monocot cell) or bacterial cell.

The term "comprise", "comprises" or "comprising," when used in this specification, indicates the presence of the stated features, integers, steps, operations, elements, or components, but does not preclude the presence or addition of one or more other features, integers, steps, operations, elements, components, and/or groups thereof.

As used herein, the transitional phrase "consisting essentially of" (and grammatical variants) means that the scope of a claim is to be interpreted to encompass the specified materials or steps recited in the claim "and those that do not materially alter the basic and novel characteristic(s)" of the claimed invention. Thus, the term "consisting essentially of" when used in a claim of this invention is not intended to be interpreted to be equivalent to "comprising."

"Expression cassette" as used herein means a nucleic acid molecule capable of directing expression of at least one polynucleotide of interest, such as a R-gene polynucleotide that encodes protein of the invention, in an appropriate host cell, comprising a promoter operably linked to the polynucleotide of interest which is operably linked to a termination signal. An "expression cassette" also typically comprises additional polynucleotides to facilitate proper translation of the polynucleotide of interest. The expression cassette may also comprise other polynucleotides not related to the expression of a polynucleotide of interest but which are present due to convenient restriction sites for removal of the cassette from an expression vector. In embodiments, at least one of the components in the expression cassette may be heterologous (i.e, foreign) with respect to at least one of the other components (e.g., a heterologous promoter operatively associated with a polynucleotide of interest). The expression cassette may also be one that is naturally occurring but has been obtained in a recombinant form useful for heterologous expression. Typically, however, the expression cassette is heterologous with respect to the host, i.e, the expression cassette (or even the polynucleotide of interest) does not occur naturally in the host cell and has been introduced into the host cell or an ancestor cell thereof by a transformation process or a breeding process. The expression of the polynucleotide(s) of interest in the expression cassette is generally under the control of a promoter. In the case of a multicellular organism, such as a plant, the promoter can also be specific or preferential to a particular tissue, or organ, or stage of development (as described in more detail herein). An expression cassette, or fragment thereof, can also be referred to as "inserted polynucleotide" or "insertion polynucleotide" when transformed into a plant.

A "gene" is defined herein as a hereditary unit comprising one or more polynucleotides that occupies a specific location on a chromosome or plasmid and that contains the genetic instruction for a particular characteristic or trait in an organism.

The term "introduced" as used herein, in connection to a plant, means accomplished by any manner including but not limited to; introgression, transgenic, Clustered Regularly Interspaced Short Palindromic Repeats modification (CRISPR), Transcription activator-like effector nucleases (TALENs) (Feng et al. 2013, Joung & Sander 2013), meganucleases, or zinc finger nucleases (ZFNs).

As used herein, the term "wild glycine" refers to a perennial *Glycine* plant, for example any one of *G. canescens, G. argyrea, G. clandestina, G. latrobeana, G. albicans, G. aphyonota, G. arenaria, G. curvata, G. cyrtoloba, G. dolichocarpa, G. falcate, G. gracei, G. hirticaulis, G. lactovirens, G. latifolia, G. microphylla, G. montis-clouglas, G. peratosa, G. pescadrensis, G. pindanica, G. pulleng G. rubiginosa, G. stenophita, G. syndetika*, or *G. tomentella.*

As used herein, the term "allele" refers to one of two or more different nucleotides or nucleotide sequences that occur at a specific locus.

A marker is "associated with" a trait when it is linked to it and when the presence of the marker is an indicator of whether and/or to what extent the desired trait or trait form will occur in a plant/germplasm comprising the marker. Similarly, a marker is "associated with" an allele when it is linked to it and when the presence of the marker is an indicator of whether the allele is present in a plant/germplasm comprising the marker. For example, "a marker associated with enhanced pathogen resistance" refers to a marker whose presence or absence can be used to predict whether and/or to what extent a plant will display a pathogen resistant phenotype.

As used herein, the terms "backcross" and "backcrossing" refer to the process whereby a progeny plant is repeatedly crossed back to one of its parents. In a backcrossing scheme, the "donor" parent refers to the parental plant with the desired gene or locus to be introgressed. The "recipient" parent (used one or more times) or "recurrent" parent (used two or more times) refers to the parental plant into which the gene or locus is being introgressed. For example, see Ragot, M. et al. *Marker-assisted Backcrossing: A Practical Example*, In Techniques et Utilisations Des Marqueurs Moleculaires Les Colloques, Vol. 72, pp. 45-56 (1995); and Openshaw et al., *Marker-assisted Selection in Backcross Breeding*, in Proceedings of the Symposium "Analysis of Molecular Marker Data," pp. 41-53 (1994). The initial cross gives rise to the F1 generation. The term "BC1" refers to the second use of the recurrent parent, "BC2" refers to the third use of the recurrent parent, and so on.

A centimorgan ("cM") is a unit of measure of recombination frequency. One cM is equal to a 1% chance that a marker at one genetic locus will be separated from a marker at a second locus due to crossing over in a single generation.

As used herein, the term "chromosomal interval defined by and including," used in reference to particular loci and/or alleles, refers to a chromosomal interval delimited by and encompassing the stated loci/alleles.

As used herein, the terms "cross" or "crossed" refer to the fusion of gametes via pollination to produce progeny (e.g., cells, seeds or plants). The term encompasses both sexual crosses (the pollination of one plant by another) and selfing (self-pollination, e.g., when the pollen and ovule are from the same plant). The term "crossing" refers to the act of fusing gametes via pollination to produce progeny.

As used herein, the terms "cultivar" and "variety" refer to a group of similar plants that by structural or genetic features and/or performance can be distinguished from other varieties within the same species.

As used herein, the terms "desired allele", "favorable allele" and "allele of interest" are used interchangeably to refer to an allele associated with a desired trait (e.g. ASR resistance).

As used herein, the terms "enhanced pathogen resistance" or "enhanced disease resistance" refers to an improvement, enhancement, or increase in a plant's ability to endure and/or thrive despite being infected with a disease (e.g. Asian soybean rust) as compared to one or more control plants (e.g., one or both of the parents, or a plant lacking a marker associated with enhanced pathogen resistance to respective pathogen/disease). Enhanced disease resistance includes any mechanism (other than whole-plant immunity or resistance) that reduces the expression of symptoms indicative of infection for a respective disease such as Asian soybean rust, soybean cyst nematode, *Phytophthora*, etc.

An "elite line" or "elite strain" is an agronomically superior line that has resulted from many cycles of breeding and selection for superior agronomic performance. Numerous elite lines are available and known to those of skill in the art of soybean breeding. An "elite population" is an assortment of elite individuals or lines that can be used to represent the state of the art in terms of agronomically superior genotypes of a given crop species, such as soybean. Similarly, an "elite germplasm" or elite strain of germplasm is an agronomically superior germplasm, typically derived from and/or capable of giving rise to a plant with superior agronomic performance, such as an existing or newly developed elite line of soybean.

An "elite" plant is any plant from an elite line, such that an elite plant is a representative plant from an elite variety. Non-limiting examples of elite soybean varieties that are commercially available to farmers or soybean breeders include: AG00802, A0868, AG0902, A1923, AG2403, A2824, A3704, A4324, A5404, AG5903, AG6202 AG0934; AG1435; AG2031; AG2035; AG2433; AG2733; AG2933; AG3334; AG3832; AG4135; AG4632; AG4934; AG5831; AG6534; and AG7231 (Asgrow Seeds, Des Moines, Iowa, USA); BPR0144RR, BPR 4077NRR and BPR 4390NRR (Bio Plant Research, Camp Point, Ill., USA); DKB17-51 and DKB37-51 (DeKalb Genetics, DeKalb, Ill., USA); DP 4546 RR, and DP 7870 RR (Delta & Pine Land Company, Lubbock, Tex., USA); JG 03R501, JG 32R606C ADD and JG 55R503C (JGL Inc., Greencastle, Ind., USA); NKS 13-K2 (NK Division of Syngenta Seeds, Golden Valley, Minnesota, USA); 90M01, 91M30, 92M33, 93M11, 94M30, 95M30, 97652, P008T22R2; P16T17R2; P22T69R; P25T51R; P34T07R2; P35T58R; P39T67R; P47T36R; P46T21R; and P56T03R2 (Pioneer Hi-Bred International, Johnston, Iowa, USA); SG4771NRR and SG5161NRR/STS (Soygenetics, LLC, Lafayette, Ind., USA); S00-K5, S11-L2, 528-Y2, S43-61, S53-A1, 576-L9, S78-G6, 50009-M2; S007-Y4; 504-D3; 514-A6; S20-T6; 521-M7; S26-P3; S28-N6; S30-V6; S35-C3; 536-Y6; S39-C4; S47-K5; S48-D9; S52-Y2; 558-Z4; S67-R6; S73-S8; and S78-G6 (Syngenta Seeds, Henderson, Ky., USA); Richer (Northstar Seed Ltd. Alberta, CA); 14RD62 (Stine Seed Co. la., USA); or Armor 4744 (Armor Seed, LLC, Ar., USA).

The terms "agronomically elite" as used herein, means a genotype that has a culmination of many distinguishable traits such as emergence, vigor, vegetative vigor, disease resistance, seed set, standability, yield and threshability which allows a producer to harvest a product of commercial significance.

As used herein, the term "commercially significant yield" or "agronomically acceptable yield" refers to a grain yield of at least 100% of a commercial check variety such as AG2703 or DKB23-51.

A "native" or "wild type" nucleic acid, nucleotide sequence, polypeptide or amino acid sequence refers to a naturally occurring or endogenous nucleic acid, nucleotide sequence, polypeptide or amino acid sequence. Thus, for example, a "wild type mRNA" is an mRNA that is naturally occurring in or endogenous to the organism.

The terms "nucleic acid," "nucleic acid molecule," "nucleotide sequence," "oligonucleotide", "polynucleic acids" and "polynucleotide" are used interchangeably herein, unless the context indicates otherwise, and refer to a heteropolymer of nucleotides. These terms include without limitation DNA and RNA molecules, including cDNA, genomic DNA, synthetic (e.g., chemically synthesized) DNA and RNA, plasmid DNA, mRNA, anti-sense RNA, and RNA/DNA hybrids, any of which can be linear or branched, single stranded or double stranded, or a combination thereof. When dsRNA is produced synthetically, less common bases, such as inosine, 5-methylcytosine, 6-methyladenine, hypoxanthine and others can also be used for antisense, dsRNA, and ribozyme pairing. For example, polynucleotides that contain C-5 propyne analogues of uridine and cytidine have been shown to bind RNA with high affinity and to be potent antisense inhibitors of gene expression. Other modifications, such as modification to the phosphodiester backbone, or the 2'-hydroxy in the ribose sugar group of the RNA can also be made. In embodiments, the "nucleic acid," "nucleic acid molecule,", "nucleotide sequence,", "oligonucleotide" or "polynucleotide" refer to DNA.

By "operably linked" or "operably associated" as used herein, it is meant that the indicated elements are functionally related to each other, and are also generally physically related. Thus, the term "operably linked" or "operably associated" as used herein, refers to nucleotide sequences on a single nucleic acid molecule that are functionally associated. Thus, a first nucleotide sequence that is operably linked to a second nucleotide sequence, means a situation when the first nucleotide sequence is placed in a functional relationship with the second nucleotide sequence. For instance, a promoter is operably associated with a nucleotide sequence if the promoter effects the transcription or expression of said nucleotide sequence. Those skilled in the art will appreciate that the control sequences (e.g., promoter) need not be contiguous with the nucleotide sequence to which it is operably associated, as long as the control sequences function to direct the expression thereof. Thus, for example, intervening untranslated, yet transcribed, sequences can be present between a promoter and a nucleotide sequence, and the promoter can still be considered "operably linked" to or "operatively associated" with the nucleotide sequence.

As used herein, the terms "disease tolerance" and "disease resistant" refer to a plant's ability to endure and/or thrive despite being infected with a respective disease. When used in reference to germplasm, the terms refer to the ability of a plant that arises from that germplasm to endure and/or thrive despite being infected with a respective disease. In some embodiments, infected Disease resistant soybean plants may yield as well (or nearly as well) as uninfected soybean plants. In general, a plant or germplasm is labeled as "Disease resistant" if it displays "enhanced pathogen resistance."

As used herein, the term "endogenous" refers to materials originating from within an organism or cell. "Exogenous" refers to materials originating from outside of an organism or cell. This typically applies to nucleic acid molecules used in producing transformed or transgenic host cells and plants.

As used herein, the terms "exotic," "exotic line" and "exotic germplasm" refer to any plant, line or germplasm that is not elite. In general, exotic plants/germplasms are not derived from any known elite plant or germplasm, but rather are selected to introduce one or more desired genetic elements into a breeding program (e.g., to introduce novel alleles into a breeding program).

As used herein, a "genetic map" is a description of genetic linkage relationships among loci on one or more chromosomes within a given species, generally depicted in a diagrammatic or tabular form. For each genetic map, distances between loci are measured by the recombination frequencies between them. Recombinations between loci can be detected using a variety of markers. A genetic map is a product of the mapping population, types of markers used, and the polymorphic potential of each marker between different populations. The order and genetic distances between loci can differ from one genetic map to another.

As used herein, the term "genome" as it applies to plant cells encompasses not only chromosomal DNA found within the nucleus, but organelle DNA found within subcellular components of the cell. The term "gene" refers to polynucleic acids that comprise chromosomal DNA, plasmid DNA, cDNA, an artificial DNA polynucleotide, or other DNA that is transcribed into an RNA molecule, wherein the RNA may encode a peptide, polypeptide, or protein, and the genetic elements flanking the coding sequence that are involved in the regulation of expression of the mRNA or polypeptide of the present invention. A "fragment" of a gene is a portion of a full-length polynucleic acid molecule that is of at least a minimum length capable of transcription into a RNA, translation into a peptide, or useful as a probe or primer in a DNA detection method.

As used herein, the term "genotype" refers to the genetic constitution of an individual (or group of individuals) at one or more genetic loci, as contrasted with the observable and/or detectable and/or manifested trait (the phenotype). Genotype is defined by the allele(s) of one or more known loci that the individual has inherited from its parents. The term genotype can be used to refer to an individual's genetic constitution at a single locus, at multiple loci, or more generally, the term genotype can be used to refer to an individual's genetic make-up for all the genes in its genome. Genotypes can be indirectly characterized, e.g., using markers and/or directly characterized by nucleic acid sequencing.

As used herein, the term "germplasm" refers to genetic material of or from an individual (e.g., a plant), a group of individuals (e.g., a plant line, variety or family), or a clone derived from a line, variety, species, or culture. The germplasm can be part of an organism or cell, or can be separate from the organism or cell. In general, germplasm provides genetic material with a specific molecular makeup that provides a physical foundation for some or all of the hereditary qualities of an organism or cell culture. As used herein, germplasm may refer to seeds, cells (including protoplasts and calli) or tissues from which new plants may be grown, as well as plant parts that can be cultured into a whole plant (e.g., stems, buds, roots, leaves, etc.).

As used herein, a "Heterologous DNA" sequence refers to a polynucleotide sequence that originates from a foreign source or species or, if from the same source, is modified from its original form.

As used herein, a "Homologous DNA" refers to DNA from the same source as that of the recipient cell.

As used herein, the term "hybrid" refers to a seed and/or plant produced when at least two genetically dissimilar parents are crossed.

As used herein, the term "inbred" refers to a substantially homozygous plant or variety. The term may refer to a plant or variety that is substantially homozygous throughout the entire genome or that is substantially homozygous with respect to a portion of the genome that is of particular interest.

As used herein, the term "indel" refers to an insertion or deletion in a pair of nucleotide sequences, wherein a first sequence may be referred to as having an insertion relative to a second sequence or the second sequence may be referred to as having a deletion relative to the first sequence.

As used herein, the terms "introgression," "introgressing" and "introgressed" refer to both the natural and artificial transmission of a desired allele or combination of desired alleles of a genetic locus or genetic loci from one genetic background to another. For example, a desired allele at a specified locus can be transmitted to at least one progeny via a sexual cross between two parents of the same species, where at least one of the parents has the desired allele in its genome. Alternatively, for example, transmission of an allele can occur by recombination between two donor genomes, e.g., in a fused protoplast, where at least one of the donor protoplasts has the desired allele in its genome. The desired allele may be a selected allele of a marker, a QTL, a transgene, or the like. Offspring comprising the desired allele can be repeatedly backcrossed to a line having a desired genetic background and selected for the desired allele, with the result being that the desired allele becomes fixed in the desired genetic background. For example, a marker associated with enhanced ASR tolerance may be introgressed from a donor into a recurrent parent that is not disease resistant. The resulting offspring could then be repeatedly backcrossed and selected until the progeny possess the ASR tolerance allele(s) in the recurrent parent background.

As used herein, an "isolated" nucleic acid molecule is substantially separated away from other nucleic acid sequences with which the nucleic acid is normally associated, such as, from the chromosomal or extrachromosomal DNA of a cell in which the nucleic acid naturally occurs. A nucleic acid molecule is an isolated nucleic acid molecule when it comprises a transgene or part of a transgene present in the genome of another organism. The term also embraces nucleic acids that are biochemically purified so as to substantially remove contaminating nucleic acids and other cellular components. The term "transgene" refers to any polynucleic acid molecule normative to a cell or organism transformed into the cell or organism. "Transgene" also encompasses the component parts of a native plant gene modified by insertion of a normative polynucleic acid molecule by directed recombination or site specific mutation.

A polypeptide is "isolated" if it has been separated from the cellular components (nucleic acids, lipids, carbohydrates, and other polypeptides) that naturally accompany it or that is chemically synthesized or recombinant. A polypeptide molecule is an isolated polypeptide molecule when it is expressed from a transgene in another organism. A monomeric polypeptide is isolated when at least 60% by weight of a sample is composed of the polypeptide, preferably 90% or more, more preferably 95% or more, and most preferably more than 99%. Protein purity or homogeneity is indicated, for example, by polyacrylamide gel electrophoresis of a protein sample, followed by visualization of a single polypeptide band upon staining the polyacrylamide gel; high pressure liquid chromatography; or other conventional methods. Proteins can be purified by any of the means known in the art, for example as described in Guide to Protein Purification, ed. Deutscher, Meth. Enzymol. 185, Academic Press, San Diego, 1990; and Scopes, Protein Purification: Principles and Practice, Springer Verlag, New York, 1982.

Using well-known methods, the skilled artisan can readily produce nucleotide and amino acid sequence variants of genes and proteins that provide a modified gene product. Chemical synthesis of nucleic acids can be performed, for example, on automated oligonucleotide synthesizers. Such variants preferably do not change the reading frame of the protein-coding region of the nucleic acid. The present invention also encompasses fragments of a protein that lacks at least one residue of a full-length protein, but that substantially maintains activity of the protein.

A "locus" is a position on a chromosome where a gene or marker or allele is located. In some embodiments, a locus may encompass one or more nucleotides.

A "non-naturally occurring variety of soybean" is any variety of soybean that does not naturally exist in nature. A "non-naturally occurring variety of soybean" may be produced by any method known in the art, including, but not limited to, transforming a soybean plant or germplasm, transfecting a soybean plant or germplasm and crossing a naturally occurring variety of soybean with a non-naturally occurring variety of soybean. In some embodiments, a "non-naturally occurring variety of soybean" may comprise one of more heterologous nucleotide sequences. In some embodiments, a "non-naturally occurring variety of soybean" may comprise one or more non-naturally occurring copies of a naturally occurring nucleotide sequence (i.e, extraneous copies of a gene that naturally occurs in soybean). In some embodiments, a "non-naturally occurring variety of soybean" may comprise a non-natural combination of two or more naturally occurring nucleotide sequences (Le, two or more naturally occurring genes that do not naturally occur in the same soybean, for instance genes not found in *Glycine max* lines).

As used herein, the terms "phenotype," "phenotypic trait" or "trait" refer to one or more traits and/or manifestations of an organism. The phenotype can be a manifestation that is observable to the naked eye, or by any other means of evaluation known in the art, e.g., microscopy, biochemical analysis, or an electromechanical assay. In some cases, a phenotype or trait is directly controlled by a single gene or genetic locus, i.e., a "single gene trait." In other cases, a phenotype or trait is the result of several genes. It is noted that, as used herein, the term "disease resistant phenotype" takes into account environmental conditions that might affect the respective disease such that the effect is real and reproducible.

As used herein, the term "plant" may refer to a whole plant, any part thereof, or a cell or tissue culture derived from a plant. Thus, the term "plant" can refer to any of: whole plants, plant components or organs (e.g., roots, stems, leaves, buds, flowers, pods, etc.), plant tissues, seeds and/or plant cells. A plant cell is a cell of a plant, taken from a plant, or derived through culture from a cell taken from a plant. Thus, the term "soybean plant" may refer to a whole soybean plant, one or more parts of a soybean plant (e.g., roots, root tips, stems, leaves, buds, flowers, pods, seeds, cotyledons, etc.), soybean plant cells, soybean plant protoplasts and/or soybean plant calli.

A "plant cell" is a structural and physiological unit of a plant, comprising a protoplast and a cell wall. The plant cell may be in the form of an isolated single cell or a cultured cell, or as a part of a higher organized unit such as, for example, plant tissue, a plant organ, or a whole plant. In embodiments, the plant cell is non-propagating and/or cannot regenerate a whole plant.

A "plant cell culture" means a culture of plant units such as, for example, protoplasts, cell culture cells, cells in plant tissues, pollen, pollen tubes, ovules, embryo sacs, zygotes and embryos at various stages of development.

"Plant material" refers to leaves, stems, roots, flowers or flower parts, fruits, pollen, egg cells, zygotes, seeds, cuttings, cell or tissue cultures, or any other part or product of a plant.

A "plant organ" is a distinct and visibly structured and differentiated part of a plant such as a root, stem, leaf, flower bud, or embryo.

As used herein, the term "plant part" includes but is not limited to embryos, pollen, ovules, seeds, leaves, flowers, branches, fruit, stalks, roots, root tips, anthers, and/or plant cells including plant cells that are intact in plants and/or parts of plants, plant protoplasts, plant tissues, plant cell tissue cultures, plant calli, plant clumps, and the like.

"Plant tissue" as used herein means a group of plant cells organized into a structural and functional unit. Any tissue of a plant in planta or in culture is included. This term includes, but is not limited to, whole plants, plant organs, plant seeds, tissue culture and any groups of plant cells organized into structural or functional units. The use of this term in conjunction with, or in the absence of, any specific type of plant tissue as listed above or otherwise embraced by this definition is not intended to be exclusive of any other type of plant tissue.

"Polyadenylation signal" or "polyA signal" refers to a nucleic acid sequence located 3' to a coding region that causes the addition of adenylate nucleotides to the 3' end of the mRNA transcribed from the coding region.

"Polymerase chain reaction (PCR)" refers to a DNA amplification method that uses an enzymatic technique to create multiple copies of one sequence of nucleic acid (amplicon). Copies of a DNA molecule are prepared by shuttling a DNA polymerase between two amplimers. The basis of this amplification method is multiple cycles of temperature changes to denature, then re-anneal amplimers (DNA primer molecules), followed by extension to synthesize new DNA strands in the region located between the flanking amplimers. Nucleic-acid amplification can be accomplished by any of the various nucleic-acid amplification methods known in the art, including the polymerase chain reaction (PCR). A variety of amplification methods are known in the art and are described, inter alia, in U.S. Pat. Nos. 4,683,195 and 4,683,202 and in PCR Protocols: A Guide to Methods and Applications, ed. Innis et al., Academic Press, San Diego, 1990. PCR amplification methods have been developed to amplify up to 22 kb of genomic DNA and up to 42 kb of bacteriophage DNA (Cheng et al., Proc. Natl. Acad. Sci. USA 91:5695-5699, 1994). These methods as well as other methods known in the art of DNA amplification may be used in the practice of the present invention.

As used herein, the term "primer" refers to an oligonucleotide which is capable of annealing to a nucleic acid target and serving as a point of initiation of DNA synthesis when placed under conditions in which synthesis of a primer extension product is induced (e.g., in the presence of nucleotides and an agent for polymerization such as DNA polymerase and at a suitable temperature and pH). A primer (in some embodiments an extension primer and in some embodiments an amplification primer) is in some embodiments single stranded for maximum efficiency in extension and/or amplification. In some embodiments, the primer is an oligodeoxyribonucleotide. A primer is typically sufficiently long to prime the synthesis of extension and/or amplification products in the presence of the agent for polymerization. The minimum length of the primer can depend on many factors, including, but not limited to temperature and composition (A/T vs. G/C content) of the primer. In the context of amplification primers, these are typically provided as a pair of bi-directional primers consisting of one forward and one reverse primer or provided as a pair of forward primers as commonly used in the art of DNA amplification such as in PCR amplification. As such, it will be understood that the term "primer," as used herein, can refer to more than one primer, particularly in the case where there is some ambiguity in the information regarding the terminal sequence(s) of the target region to be amplified. Hence, a "primer" can include a collection of primer oligonucleotides containing sequences representing the possible variations in the sequence or includes nucleotides which allow a typical base pairing. Primers can be prepared by any suitable method known in the art. Methods for preparing oligonucleotides of specific sequence are known in the art, and include, for example, cloning and restriction of appropriate sequences and direct chemical synthesis. Chemical synthesis methods can include, for example, the phospho di- or tri-ester method, the diethylphosphoramidate method and the solid support method disclosed in U.S. Pat. No. 4,458,066. Primers can be labeled, if desired, by incorporating detectable moieties by for instance spectroscopic, fluorescence, photochemical, biochemical, immunochemical, or chemical moieties. Primers diagnostic (i.e. able to identify or select based on presence of ASR resistant alleles) for ASR resistance can be created to any favorable SNP as described in any one of Tables 1-5. The PCR method is well described in handbooks and known to the skilled person. After amplification by PCR, target polynucleotides can be detected by hybridization with a probe polynucleotide, which forms a stable hybrid with the target sequence under stringent to moderately stringent hybridization and wash conditions. If it is expected that the probes are essentially completely complementary (i.e., about 99% or greater) to the target sequence, stringent conditions can be used. If some mismatching is expected, for example if variant strains are expected with the result that the probe will not be completely complementary, the stringency of hybridization can be reduced. In some embodiments, conditions are chosen to rule out non-specific/adventitious binding. Conditions that affect hybridization, and that select against non-specific binding are known in the art, and are described in, for example, Sambrook & Russell (2001). Molecular Cloning: A Laboratory Manual, Third Edition, Cold Spring Harbor Laboratory Press, Cold Spring Harbor, New York, United States of America. Generally, lower salt concentration and higher temperature hybridization and/or washes increase the stringency of hybridization conditions.

As used herein, the terms "progeny" and "progeny plant" refer to a plant generated from a vegetative or sexual reproduction from one or more parent plants. A progeny plant may be obtained by cloning or selfing a single parent plant, or by crossing two parental plants.

The term "promoter" or "promoter region" refers to a polynucleic acid molecule that functions as a regulatory element, usually found upstream (5') to a coding sequence, that controls expression of the coding sequence by controlling production of messenger RNA (mRNA) by providing the recognition site for RNA polymerase and/or other factors necessary for start of transcription at the correct site. As contemplated herein, a promoter or promoter region includes variations of promoters derived by means of ligation to various regulatory sequences, random or controlled mutagenesis, and addition or duplication of enhancer sequences. The promoter region disclosed herein, and biologically functional equivalents thereof, are responsible for driving the transcription of coding sequences under their control when introduced into a host as part of a suitable recombinant DNA construct, as demonstrated by its ability to produce mRNA.

A "recombinant" nucleic acid is made by a combination of two otherwise separated segments of nucleic acid sequence, for example, by chemical synthesis or by the manipulation of isolated segments of polynucleic acids by genetic engineering techniques. The term "recombinant DNA construct" refers to any agent such as a plasmid, cosmid, virus, autonomously replicating sequence, phage, or linear or circular single-stranded or double-stranded DNA or RNA nucleotide sequence, derived from any source, capable of genomic integration or autonomous replication, comprising a DNA molecule that one or more DNA sequences have been linked in a functionally operative manner. Such recombinant DNA constructs are capable of introducing a 5' regulatory sequence or promoter region and a DNA sequence for a selected gene product into a cell in such a manner that the DNA sequence is transcribed into a functional mRNA that is translated and therefore expressed.

Recombinant DNA constructs may be constructed to be capable of expressing antisense RNAs, or stabilized double stranded antisense RNAs.

The phrase "substantially identical," in the context of two nucleic acids or two amino acid sequences, refers to two or more sequences or subsequences that have at least about 50% nucleotide or amino acid residue identity when compared and aligned for maximum correspondence as measured using a sequence comparison algorithm or by visual inspection. In certain embodiments, substantially identical sequences have at least about 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or more nucleotide or amino acid residue identity. In certain embodiments, substantial identity exists over a region of the sequences that is at least about 50 amino acid residues, 100 amino acid residues, 150 amino acid residues, 200 amino acid residues, 250 amino acid residues, 300 amino acid residues, 350 amino acid residues, 400 amino acid residues, 450 amino acid residues, 500 amino acid residues, 525 amino acid residues, 526, amino acid residues 527 amino acid residues, 528 amino acid residues, 529 amino acid residues, 530 amino acid residues, 531 amino acid residues, 532 amino acid residues, 533 amino acid residues, 534 amino acid residues, 535 amino acid residues, 536 amino acid residues or more with respect to the protein sequence or the nucleotide sequence encoding the same. In further embodiments, the sequences are substantially identical when they are identical over the entire length of the coding regions.

"Identity" or "percent identity" refers to the degree of identity between two nucleic acid or amino acid sequences. For sequence comparison, typically one sequence acts as a reference sequence to which test sequences are compared. When using a sequence comparison algorithm, test and reference sequences are input into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

For sequence comparison, typically one sequence acts as a reference sequence to which test sequences are compared. When using a sequence comparison algorithm, test and reference sequences are input into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, Adv. Appl. Math. 2: 482 (1981), by the homology alignment algorithm of Needleman & Wunsch, J. Mol. Biol. 48: 443 (1970), by the search for similarity method of Pearson & Lipman, Proc. Nat'l. Acad. Sci. USA 85: 2444 (1988), by computerized implementations of these algorithms (GAP, BESTFIT, FASTA, and TFASTA in the Wisconsin Genetics Software Package, Genetics Computer Group, 575 Science Dr., Madison, WI), or by visual inspection (see generally).

One example of an algorithm that is suitable for determining percent sequence identity and sequence similarity is the BLAST algorithm, which is described in Altschul et al., J. Mol. Biol. 215: 403-410 (1990). Software for performing BLAST analyses is publicly available through the National Center for Biotechnology Information (on the world wide web at ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., J. Mol. Biol. 215: 403-410 (1990)). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see, Henikoff & Henikoff, Proc. Natl. Acad. Sci. USA 89: 10915 (1989)).

In addition to calculating percent sequence identity, the BLAST algorithm also performs a statistical analysis of the similarity between two sequences (see, e.g., Karlin & Altschul, Proc. Nat'l. Acad. Sci. USA 90: 5873-5787 (1993)). One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleic acid sequence to the reference nucleic acid sequence is less than about 0.1, more preferably less than about 0.01, and most preferably less than about 0.001.

Another widely used and accepted computer program for performing sequence alignments is CLUSTALW v1.6 (Thompson, et al. Nuc. Acids Res., 22: 4673-4680, 1994). The number of matching bases or amino acids is divided by the total number of bases or amino acids, and multiplied by 100 to obtain a percent identity. For example, if two 580 base pair sequences had 145 matched bases, they would be 25 percent identical. If the two compared sequences are of different lengths, the number of matches is divided by the shorter of the two lengths. For example, if there were 100 matched amino acids between a 200 and a 400 amino acid proteins, they are 50 percent identical with respect to the shorter sequence. If the shorter sequence is less than 150 bases or 50 amino acids in length, the number of matches are divided by 150 (for nucleic acid bases) or 50 (for amino acids), and multiplied by 100 to obtain a percent identity. In addition to identity positions, consensus positions are also commonly scored. Consensus amino acids are those known to have similar amino acid properties such as charge, size, polarity, and aromaticity.

Two nucleotide sequences can also be considered to be substantially identical when the two sequences hybridize to each other under stringent conditions. In representative embodiments, two nucleotide sequences considered to be substantially identical hybridize to each other under highly stringent conditions.

The terms "stringent conditions" or "stringent hybridization conditions" include reference to conditions under which a nucleic acid will selectively hybridize to a target sequence to a detectably greater degree than other sequences (e.g., at least 2-fold over a non-target sequence), and optionally may substantially exclude binding to non-target sequences. Stringent conditions are sequence-dependent and will vary under different circumstances. By controlling the stringency of the hybridization and/or washing conditions, target sequences can be identified that can be up to 100% complementary to the reference nucleotide sequence. Alternatively, conditions of moderate or even low stringency can be used to allow some mismatching in sequences so that lower degrees of sequence similarity are detected. For example, those skilled in the art will appreciate that to function as a primer or probe, a nucleic acid sequence only needs to be sufficiently complementary to the target sequence to substantially bind thereto so as to form a stable double-stranded structure under the conditions employed. Thus, primers or probes can be used under conditions of high, moderate or even low stringency. Likewise, conditions of low or moderate stringency can be advantageous to detect homolog, ortholog and/or paralog sequences having lower degrees of sequence identity than would be identified under highly stringent conditions.

The terms "complementary" or "complementarity" (and similar terms), as used herein, refer to the natural binding of polynucleotides under permissive salt and temperature conditions by base-pairing. For example, the sequence "A-G-T" binds to the complementary sequence "T-C-A." Complementarity between two single-stranded molecules may be partial, in which only some of the nucleotides bind, or it may be complete when total complementarity exists between the single stranded molecules. The degree of complementarity between nucleic acid strands has significant effects on the efficiency and strength of hybridization between the molecules. As used herein, the term "substantially complementary" (and similar terms) means that two nucleic acid sequences are at least about 50%, 60%, 70%, 75%, 80%, 85%, 90%, 95%, 96%, 97%, 98%, 99% or more complementary. Alternatively, the term "substantially complementary" (and similar terms) can mean that two nucleic acid sequences can hybridize together under high stringency conditions (as described herein).

As used herein, "specifically" or "selectively" hybridizing (and similar terms) refers to the binding, duplexing, or hybridizing of a molecule to a particular nucleic acid target sequence under stringent conditions when that sequence is present in a complex mixture (e.g., total cellular DNA or RNA) to the substantial exclusion of non-target nucleic acids, or even with no detectable binding, duplexing or hybridizing to non-target sequences. Specifically or selectively hybridizing sequences typically are at least about 40% complementary and are optionally substantially complementary or even completely complementary (i.e., 100% identical).

For DNA-DNA hybrids, the $T_m$ can be approximated from the equation of Meinkoth and Wahl, Anal. Biochem., 138: 267-84 (1984): $T_m$=81.5° C.+16.6 (log M)+0.41 (% GC)-0.61 (% formamide)-500/L; where M is the molarity of monovalent cations, % GC is the percentage of guanosine and cytosine nucleotides in the DNA, % formamide is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization and/or wash conditions can be adjusted to hybridize to sequences of the desired degree of identity. For example, if sequences with >90% identity are sought, the $T_m$ can be decreased 10° C. Generally, stringent conditions are selected to be about 5° C. lower than the thermal melting point ($T_m$) for the specific sequence and its complement at a defined ionic strength and pH. However, highly stringent conditions can utilize a hybridization and/or wash at the thermal melting point ($T_m$) or 1, 2, 3 or 4° C. lower than the thermal melting point ($T_m$); moderately stringent conditions can utilize a hybridization and/or wash at 6, 7, 8, 9 or 10° C. lower than the thermal melting point ($T_m$); low stringency conditions can utilize a hybridization and/or wash at 11, 12, 13, 14, 15 or 20° C. lower than the thermal melting point ($T_m$). If the desired degree of mismatching results in a $T_m$ of less than 45° C. (aqueous solution) or 32° C. (formamide solution), optionally the SSC concentration can be increased so that a higher temperature can be used. An extensive guide to the hybridization of nucleic acids is found in Tijssen, Laboratory Techniques in Biochemistry and Molecular Biology-Hybridization with Nucleic Acid Probes, part I, chapter 2, "Overview of principles of hybridization and the strategy of nucleic acid probe assays," Elsevier, New York (1993); Current Protocols in Molecular Biology, chapter 2, Ausubel, et al., eds, Greene Publishing and Wiley-Interscience, New York (1995); and Green & Sambrook, In: Molecular Cloning, A Laboratory Manual, 4th Edition, Cold Spring Harbor Press, Cold Spring Harbor, N.Y. (2012).

Typically, stringent conditions are those in which the salt concentration is less than about 1.5 M Na ion, typically about 0.01 to 1.0 M Na ion concentration (or other salts) at about pH 7.0 to pH 8.3 and the temperature is at least about 30° C. for short probes (e.g., 10 to 50 nucleotides) and at least about 60° C. for longer probes (e.g., greater than 50 nucleotides). Stringent conditions may also be achieved with the addition of destabilizing agents such as formamide or Denhardt's (5 g Ficoll, 5 g polyvinylpyrrolidone, 5 g bovine serum albumin in 500 ml of water). Exemplary low stringency conditions include hybridization with a buffer solution of 30% to 35% formamide, 1 M NaCl, 1% SDS (sodium dodecyl sulfate) at 37° C. and a wash in 1× to 2×SSC (20×SSC=3.0 M NaCl/0.3 M trisodium citrate) at 50° C. to 55° C. Exemplary moderate stringency conditions include hybridization in 40% to 45% formamide, 1 M NaCl, 1% SDS at 37° C. and a wash in 0.5× to 1×SSC at 55° C. to 60° C. Exemplary high stringency conditions include hybridization in 50% formamide, 1 M NaCl, 1% SDS at 37° C. and a wash in 0.1×SSC at 60° C. to 65° C. A further non-limiting example of high stringency conditions include hybridization in 4×SSC, 5×Denhardt's, 0.1 mg/ml boiled salmon sperm DNA, and 25 mM Na phosphate at 65° C. and a wash in 0.1×SSC, 0.1% SDS at 65° C. Another illustration of high stringency hybridization conditions includes hybridization in 7% SDS, 0.5 M $NaPO_4$, 1 mM EDTA at 50° C. with washing in 2×SSC, 0.1% SDS at 50° C., alternatively with washing in 1×SSC, 0.1% SDS at 50° C., alternatively with washing in 0.5×SSC, 0.1% SDS at 50° C., or alternatively with washing in 0.1×SSC, 0.1% SDS at 50° C., or even with washing in 0.1×SSC, 0.1% SDS at 65° C. Those skilled in the art will appreciate that specificity is typically a function of post-hybridization washes, the relevant factors being the ionic strength and temperature of the final wash solution.

Nucleic acids that do not hybridize to each other under stringent conditions are still substantially identical if the proteins that they encode are substantially identical (e.g., due to the degeneracy of the genetic code).

A further indication that two nucleic acids or proteins are substantially identical is that the protein encoded by the first nucleic acid is immunologically cross reactive with the protein encoded by the second nucleic acid. Thus, a protein is typically substantially identical to a second protein, for example, where the two proteins differ only by conservative substitutions.

The term "vector" refers to a composition for transferring, delivering or introducing a nucleic acid (or nucleic acids) into a cell. A vector comprises a nucleic acid molecule comprising the nucleotide sequence(s) to be transferred, delivered or introduced.

Expression of an R-Gene Coding Sequence in Plants

DNA constructs are made that contain various genetic elements necessary for the expression of the R-Gene coding sequence in plants, thereby imparting pathogen resistance to the plants in which they are expressed. "DNA construct" refers to the heterologous genetic elements operably linked to each other making up a recombinant DNA molecule and may comprise elements that provide expression of a DNA polynucleotide molecule in a host cell and elements that provide maintenance of the construct in the host cell. A plant expression cassette comprises the operable linkage of genetic elements that when transferred into a plant cell provides expression of a desirable gene product. "Plant expression cassette" refers to chimeric DNA segments comprising the regulatory elements that are operably linked to provide the expression of a transgene product in plants. Promoters, leaders, introns, transit peptide encoding polynucleic acids, 3' transcriptional termination regions are all genetic elements that may be operably linked by those skilled in the art of plant molecular biology to provide a desirable level of expression or functionality to an R-gene of the present invention. A DNA construct can contain one or more plant expression cassettes expressing the DNA molecules of the present invention or other DNA molecules useful in the genetic engineering of crop plants.

A variety of promoters specifically active in vegetative tissues, such as leaves, stems, roots and tubers, can be used to express the R-gene polynucleic acid molecules of the present invention.

The translation leader sequence means a DNA molecule located between the promoter of a gene and the coding sequence. The translation leader sequence is present in the fully processed mRNA upstream of the translation start sequence. The translation leader sequence may affect processing of the primary transcript to mRNA, mRNA stability or translation efficiency. Examples of translation leader sequences include maize and petunia heat shock protein leaders, plant virus coat protein leaders, plant rubisco gene leaders among others (Turner and Foster, Molecular Biotechnology 3:225, 1995).

The "3' non-translated sequences" means DNA sequences located downstream of a structural polynucleotide sequence and include sequences encoding polyadenylation and other regulatory signals capable of affecting mRNA processing or gene expression. The polyadenylation signal functions in plants to cause the addition of multiple adenylate nucleotides to the 3' end of the mRNA precursor. The polyadenylation sequence can be derived from the natural gene, from a variety of plant genes, or from T-DNA. An example of the polyadenylation sequence is the nopaline synthase 3' sequence (nos 3'; Fraley et al., Proc. Natl. Acad. Sci. USA 80: 4803-4807, 1983). The use of different 3' non-translated sequences is exemplified by Ingelbrecht et al., Plant Cell 1:671-680, 1989.

The laboratory procedures in recombinant DNA technology used herein are those well-known and commonly employed in the art. Standard techniques are used for cloning, DNA and RNA isolation, amplification and purification. Generally enzymatic reactions involving DNA ligase, DNA polymerase, restriction endonucleases and the like are performed according to the manufacturer's specifications. These techniques and various other techniques are generally performed according to Sambrook et al. (1989).

The DNA construct of the present invention may be introduced into the genome of a desired plant host by a variety of conventional transformation techniques that are well known to those skilled in the art. "Transformation" refers to a process of introducing an exogenous polynucleic acid molecule (for example, a DNA construct, a recombinant polynucleic acid molecule) into a cell or protoplast and that exogenous polynucleic acid molecule is incorporated into a host cell genome or an organelle genome (for example, chloroplast or mitochondria) or is capable of autonomous replication. "Transformed" or "transgenic" refers to a cell, tissue, organ, or organism into which a foreign polynucleic acid, such as a DNA vector or recombinant polynucleic acid molecule. A "transgenic" or "transformed" cell or organism also includes progeny of the cell or organism and progeny produced from a breeding program employing such a "transgenic" plant as a parent in a cross and exhibiting an altered phenotype resulting from the presence of the foreign polynucleic acid molecule.

Methods of transformation of plant cells or tissues include, but are not limited to *Agrobacterium* mediated transformation method and the Biolistics or particle-gun mediated transformation method. Suitable plant transformation vectors for the purpose of *Agrobacterium* mediated transformation include-those elements derived from a tumor inducing (Ti) plasmid of *Agrobacterium tumefaciens*, for example, right border (RB) regions and left border (LB) regions, and others disclosed by Herrera-Estrella et al., Nature 303:209 (1983); Bevan, Nucleic Acids Res. 12:8711-8721 (1984); Klee et al., Bio-Technology 3(7):637-642 (1985). In addition to plant transformation vectors derived from the Ti or root-inducing (Ri) plasmids of *Agrobacterium*, alternative methods can be used to insert the DNA constructs of this invention into plant cells. Such methods may involve, but are not limited to, for example, the use of liposomes, electroporation, chemicals that increase free DNA uptake, free DNA delivery via microprojectile bombardment, and transformation using viruses or pollen.

DNA constructs can be prepared that incorporate the R-gene coding sequences of the present invention for use in directing the expression of the sequences directly from the host plant cell plastid. Examples of such constructs suitable for this purpose and methods that are known in the art and are generally described, for example, in Svab et al., Proc. Natl. Acad. Sci. USA 87:8526-8530, (1990) and Svab et al., Proc. Natl. Acad. Sci. USA 90:913-917 (1993) and in U.S. Pat. No. 5,693,507.

When adequate numbers of cells containing the exogenous polynucleic acid molecule encoding polypeptides from the present invention are obtained, the cells can be cultured, then regenerated into whole plants. "Regeneration" refers to the process of growing a plant from a plant cell (for example, plant protoplast or explant). Such regeneration techniques rely on manipulation of certain phytohormones in a tissue culture growth medium, typically relying on a biocide and/or herbicide marker that has been introduced together with the desired nucleotide sequences. Choice of methodology for the regeneration step is not critical See, for example, Ammirato et al., Handbook of Plant Cell Culture—Crop Species. Macmillan Publ. Co. (1984); Shimamoto et al., Nature 338:274-276 (1989); Fromm, UCLA Symposium on Molecular Strategies for Crop Improvement, Apr. 16-22, 1990. Keystone, Colo. (1990); Vasil et al., Bio/Technology 8:429-434 (1990); Vasil et al., Bio/Technology 10:667-674 (1992); Hayashimoto, Plant Physiol. 93:857-863 (1990); and Datta et al., Bio-technology 8:736-740 (1990). Such regeneration techniques are described generally in Klee et al., Ann. Rev. Plant Phys. 38:467-486 (1987).

The development or regeneration of transgenic plants containing the exogenous polynucleic acid molecule that encodes a polypeptide of interest is well known in the art. Preferably, the regenerated plants are self-pollinated to provide homozygous transgenic plants, as discussed above. Otherwise, pollen obtained from the regenerated plants is crossed to seed-grown plants of agronomically important lines. Conversely, pollen from plants of these important lines is used to pollinate regenerated plants.

Disease Resistant Soybean Plants and Germplasms

The present invention provides disease resistant soybean plants and germplasms. A Disease resistant soybean plant or germplasm may be produced by any method whereby an R-gene is introduced into the soybean plant or germplasm, including, but not limited to, transformation, protoplast transformation or fusion, a double haploid technique, embryo rescue, gene editing and/or by any other nucleic acid transfer system.

In some embodiments, the soybean plant or germplasm comprises a non-naturally occurring variety of soybean. In some embodiments, the soybean plant or germplasm is at least about 50%, 55%, 60%, 65%, 70%, 75%, 80%, 85%, 90%, 95%, 97%, 99% or 100% identical to that of an elite variety of soybean.

The disease resistant soybean plant or germplasm may be the progeny of a cross between an elite variety of soybean and a variety of soybean that comprises an R-gene for enhanced Disease tolerance (e.g. ASR) wherein the R-gene is selected from the group consisting of genes encoding a protein having a TIR R-gene motif or a gene having between 70-100% homology to any of SEQ ID NOs: 7, 8, 11, or 12 while providing ASR resistance in the plant. In many examples, alternative embodiments will have at least one of at least 90%, 91%, 92%, 93%, 94%, 95%, 96%, 97%, 98%, or 99% homology to any of SEQ ID NOs: 7, 8, 11, or 12.

The disease resistant soybean plant or germplasm may be the progeny of an introgression wherein the recurrent parent is an elite variety of soybean and the donor comprises an R-gene associated with enhanced disease tolerance and/or resistance wherein the donor carries a TIR R-gene motif or a gene having between 70-100% homology to any of SEQ ID NOs: 7, 8, 11, or 12.

The disease resistant soybean plant or germplasm may be the progeny of a cross between a first elite variety of soybean (e.g., a tester line) and the progeny of a cross between a second elite variety of soybean (e.g., a recurrent parent) and a variety of soybean that comprises an R-gene.

A disease resistant soybean plant and germplasm of the present invention may comprise one or more R-genes of the present invention (e.g. any of SEQ ID NOs: 7, 8, 11, or 12).

Disease Resistant Soybean Seeds

The present invention provides disease resistant soybean seeds. As discussed above, the methods of the present invention may be utilized to identify, produce and/or select a disease resistant soybean seed. In addition to the methods described above, a disease resistant soybean seed may be produced by any method whereby an R-gene is introduced into the soybean seed, including, but not limited to, transformation, protoplast transformation or fusion, a double haploid technique, embryo rescue, genetic editing (e.g. CRISPR or TALEN or MegaNucleases) and/or by any other nucleic acid transfer system.

In some embodiments, the disease resistant soybean seed comprises a non-naturally occurring variety of soybean. In some embodiments, the soybean seed is at least about 50%, 55%, 60%, 65%, 70%, 75%, 80%, 85%, 90%, 95%, 97%, 99% or 100% identical to that of an elite variety of soybean.

The disease resistant soybean seed may be produced by a disease resistant soybean plant identified, produced or selected by the methods of the present invention.

A disease resistant soybean seed of the present invention may comprise, be selected by or produced by use of one or more R-genes of the present invention.

EXAMPLES

The following examples are not intended to be a detailed catalog of all the different ways in which the present invention may be implemented or of all the features that may be added to the present invention. Persons skilled in the art will appreciate that numerous variations and additions to the various embodiments may be made without departing from the present invention. Hence, the following descriptions are intended to illustrate some particular embodiments of the invention, and not to exhaustively specify all permutations, combinations and variations thereof.

Example 1 Identification of ASR Resistant Wild *Glycine* Lines

Multiple wild glycine (*Glycine* canescens, *Glycine clandestina, Glycine tomentella*) lines were evaluated for ASR resistance against sixteen rust strains collected across a diverse range of environments. The rust data were generated using single pustule derived isolates from USDA-ARS (FL Q09, FL Q12, LABR13, FLQ11) and field populations (FL Q15, NC06, Vero, GLC15, UBL, BR south and BR central. The screening was carried out in contained facilities.

Each wild glycine line was evaluated over a multiple day course of infection and rated at various time points. Each accession was screened >2 times with ~4 plants each time in North & South America using a large diverse panel of rust isolates.

Of the wild glycine lines screened for ASR resistance, the following lines showed broad resistance against all ASR strains tested: P1440935, P1483193, P1595799, P1339656, and P1509501.

Example 2 Allele Mining & Associations to P1440935, P1483193, P1595799, P1339656, or P1509501 ASR Loci A resistant parent line was crossed to a susceptible line of the same species (i.e. *G. canescens*×*G. canescens* and *G.* clandestina×G. clandestina) and an F1 plant was generated (See Table 5). The F1 plant was self-fertilized and F2 seed was harvested from the selfed F1 plant. Around 200 F2 seeds were sown and leaf tissue from each plant was collected for DNA preparations and then the plants were inoculated with *Phakopsora pachyrhizi* to determine the resistance/susceptible phenotype of each F2 individual. Tissue from 50 resistant F2s and 50 susceptible F2s were combined in separate pools and genomic DNA was prepared from each pool. Illumina sequencing libraries were prepared from DNA for each of the pools and each library was sequenced in two Illumina HiSeq2000 2×100 bp Paired-End (PE) lanes. The average yield per sample was 383 million read pairs, which equals 77 gigabases of sequence per library. The sequencing reads were trimmed to remove bases with PHRED quality scores of <15.

Quality trimmed reads were aligned to the P1440935 and P1595799 reference genome sequences for *G. canescens* and to the P1339656 reference genome for *G. clandestina* using GSNAP (WU and NACU 2010) as paired-end fragments. If a pair of reads could not be aligned together, they were treated as singletons for alignment. Reads were used in subsequent analyses if they mapped uniquely to the reference (2 mismatches every 36 bp and less than 5 bases for every 75 bp as tails).

SNPs were filtered prior to Bulk segregation analysis (BSA) based on read depth, with SNPs having between 40 and 200× read depth being retained. A Chi-square test was used to select SNPs with significantly different read counts between the two alleles in the two pools. An empirical Bayesian approach (LIU et al. 2012) was used to estimate the conditional probability that there is no recombination between each SNP marker and the causal locus in both the resistant pool and in the susceptible pool. The probability of the linkage between the SNP and the causal gene is the geometric mean of these two conditional probabilities. Around 1000 SNPs were found to have possible linkage to the target locus. A subset of these putatively linked SNPs was used to fine map the locus using phenotyped F2 individuals. See references: LIU, S., C.-T. YEH, H. M. TANG, D. NETTLETON AND P. S. SCHNABLE, 2012 Gene Mapping via Bulked Segregant RNA-Seq (BSR-Seq). PLoS ONE 7: e36406 & Wu, T. D., and S. Nacu, 2010 Fast and SNP-tolerant detection of complex variants and splicing in short reads. Bioinformatics 26: 873-881.

TABLE 5

Plant Crossings & Study Type

| Species | PI# (male) | PI # (female | Study Type | F2: Resistant to Susceptible Ratio |
|---|---|---|---|---|
| *G. canescens* | PI 440935 | PI 505154 | BSA | 3:1 |
| *G. canescens* | PI 440935 | PI 505154 | Indexing | 3:1 |
| *G. canescens* | PI 483193 | PI 505154 | BSR + DEG | 3:1 |
| *G. canescens* | PI 595799 | PI 505154 | Indexing | 3:1 |
| *G. clandestina* | PI 339656 | PI 446943 | BSA | 3:1 |

1. PI440935 Data2Bio LLC (Ames, Iowa) Lab Methodology for gBSA-Seq Analysis for Tetraploid Soybean.

Chromosome discovery for causal loci in the tetraploid soybean population, PI440935 was carried out using Data2Bio's Genomic Bulked Segregant Analysis (gBSA) technology. It was theorized that resistance is controlled by a single dominant gene. Data2Bio generated several libraries from DNA samples extracted from two susceptible tissue pools and two resistant tissue pools and sequenced these in eight (8) Illumina HiSeq2000 2×100 bp Paired-End (PE) lanes. A summary of the reference genomes used for subsequent analyses, read processing from raw data to quality trimming, alignment, SNP discovery and SNP impact are demonstrated in FIGS. 11-13. After various filtering steps 1,099,754 and 324,931 informative SNPs were identified in the PI440935 genome. A Bayesian approach was then used to calculate trait-associated probabilities. Next, physical maps of trait-associated SNPs (probability cutoff 0.01) for the top contigs were created (FIGS. 13-15). One scaffold, scaffold 000056F, was identified and mapped to chromosome 14 of PI440953 (SEQ ID NOs: 1). SNPs from this enriched scaffold were mapped to the public *G. max* genome. An additional smaller cluster of SNPs from other scaffolds were also observed on chromosome 6 (see FIGS. 11-12).

2. PI595799 Data2Bio LLC (Ames, Iowa) Lab Methodology for gBSA-Seq Analysis for Tetraploid Soybean Chromosome discovery for causal loci in the tetraploid soybean population, PI595799 was carried out. A physical map of trait-associated SNPs on contigs was created. The clustering of these SNPs indicates that the resistance gene is located on or near scaffold 000090F (SEQ ID NO: 2). The context sequences associated with these SNPs were also aligned to the public *G. max* genome to create a chromosome-level understanding of the mapping interval. The chromosomal positions of the trait-associated SNPs were then displayed graphically.

3. PI339656 Data2Bio LLC (Ames, Iowa) Lab Methodology for gBSA-Seq Analysis for Tetraploid Soybean.

Chromosome discovery for causal loci in the tetraploid soybean population, PI339656 was carried out using Data2Bio's Genomic Bulked Segregant Analysis (gBSA) technology. It was theorized that resistance is controlled by a single dominant allele. Data2Bio generated several libraries from DNA samples extracted from two susceptible tissue pools and two resistant tissue pools and sequenced these in eight (8) Illumina HiSeq2000 2×100 bp Paired-End (PE) lanes. A summary of the reference genomes used for subsequent analyses, read processing from raw data to quality trimming, alignment, SNP discovery and SNP impact are demonstrated in FIGS. 4-6. After various filtering steps 4,610,234 informative SNPs were identified in the PI339656 genome. A Bayesian approach was then used to calculate trait-associated probabilities. Next, physical maps of trait-associated SNPs (probability cutoff 0.01) for the top contigs were created (FIGS. 13-15). One scaffold, scaffold 14851, was identified and mapped to chromosome 14 of PI339656 (SEQ ID NO: 1). SNPs from this enriched scaffold were mapped to the public *G. max* genome. The data suggest that the causative R gene may map within or near the interval from 3.18 to 3.5 MB on chromosome 14.

Example 3 Embryo Rescue & Introgression of R Gene Intervals into *Glycine max* Lines Embryo rescue is performed and chemical treatment is applied in order to generate amphidiploid shoots. If the amphidiploid plants are fertile they will be used to backcross with *G. max*. Backcrossing with *G. max* and subsequent embryo rescue will need to be performed for several generations in order to gradually eliminate the perennial wild glycine chromosomes.

Wide crosses: Elite Syngenta soybean lines (RM 3.7 to 4.8) were used as the females (pollen recipients) and multiple accessions of *Glycine canescens, G. clandestina*, and *G. tomentella* were used as the males or pollen donors.

Selecting flowers from the glycine plant containing anthers at the proper developmental stage is important. New, fully-opened, brightly colored flowers hold anthers with mature pollen. The pollen should appear as loose, yellow dust. These flowers are removed from the glycine plant and taken to the soybean plant for pollination. Pollen from the *Glycine* plants should be used within 30 minutes of flower removal. It is also important to identify and select soybean flower buds that are ready for pollination. A soybean flower bud is generally ready when it is larger in size when compared to an immature bud. The sepals of the soybean blossoms are lighter in color and the petals are just beginning to appear. First, use a pair of fine-tipped tweezers to carefully detach the sepals from the flower bud to expose the outer set of petals. Then gently grasp and remove the petals (5 in total) from the flower exposing the ring of stamens surrounding the pistil. Since the stigma is receptive to pollen 1 day before the anthers begin shedding pollen it is important to recognize the stage development of "female ready, male not ready". When pollinating soybean flowers at this developmental stage it is not necessary to emasculate the female flower. Locate the stigma on the soybean flower. Then using 1 male flower, carefully peel off the petals to expose the anthers and gently dust the pollen grains onto the stigma of the soybean flower. Care should be taken not to damage the stigma at any time during this process. Starting the day after pollination a hormone mixture is sprayed onto the pollinated flower and eventual developing F1 pod 1× every day until harvest. The pollinated flower or pod is saturated with a light mist of the hormone mixture, taking care not to cause the flower/pod to prematurely detach from the plant. The mixture contains 100 mg GA3, 25 mg NAA and 5 mg kinetin/L distilled water. These hormones aid in the retention of the developing pod and in increased pod growth.

Harvest: Pods from wide crosses are harvested at approximately 14 to 16 days post pollination. (Harvest dates in the literature suggest 19 to 21 days.) Before selecting an individual pod to harvest verify that the sepals were removed (this indicates a wide cross attempt) and that the seed size is as expected for a wide cross. Pods are collected and counted according to wide cross combination to determine crossing success. The average crossing success across multiple soybean females and 5 different accessions of *Glycine canescens* is approximately 40%. The wide cross pods can contain 1 to 3 seeds but generally 2 seeds are found in each F1 pod.

Embryo rescue: Harvested pods are collected and brought back to the lab to be sterilized. The pods are first rinsed with 70% EtOH for 2 to 3 minutes and then placed in 10% Clorox bleach for an additional 30 minutes on a platform shaker at approximately 130 RPM. Finally, the pods are rinsed multiple times with sterile water to remove any residual bleach. Embryo isolation can begin immediately following pod sterilization or pods can be stored at 4° C. for up to 24 hours prior to embryo isolation. The sterilized pods are next taken to a laminar flow hood where the embryos can be rescued. Individual pods are placed in a sterile petri dish and opened using a scalpel and forceps. An incision is made along the length of the wide cross pod away from the seed. The pod can then be easily opened to expose the seed. Alternatively, two pair of forceps can be used to separate the pod shell. Carefully remove the seed from the pod and place in a sterile petri dish under the dissection microscope. Very fine forceps are needed to isolate the embryo from the seed. With forceps in one hand, gently hold the side of the seed away from the embryo, with hilum facing up. Use another pair of forceps in the other hand to remove the seed coat from the side of the seed containing the embryo. Peel off the membrane surrounding the embryo and push the embryo up from tis bottom side. Embryos should be past the globular developmental stage and preferably past the early heart developmental stage (middle to late heart stage, cotyledon stage and early maturation stage embryos are desired). Isolated embryos are transferred to embryo rescue medium such as Soy ER1-1. Embryos can be treated to induce chromosome doubling at this time. (See below for chromosome doubling details.) Isolated embryos remain on embryo rescue medium for 21 to 30 days at 24° C. Embryos may remain in the dark for the entire incubation on ER1-1, may begin the incubation in the dark and complete it in the light, or may spend the entire incubation in the light. There is not a callus induction stage in this protocol. Shoots are developed directly from the embryos.

Chromosome doubling treatments: Either colchicine of trifluralin can be used to induce chromosome doubling. Ideally, late heart stage wide cross embryos (or larger) are chemically treated to induce chromosome doubling at any time from immediately following isolation up to 1 week post isolation. The doubling agent can be mixed in either solid or liquid medium and applied for several hours or up to a few days. Trifluralin is used at a concentration of 10-40 uM in either solid or liquid media. Additionally, colchicine is used at a concentration of 0.4-1 mg/ml in either solid or liquid media. Following the chemical treatment the embryos are transferred to fresh embryo rescue medium.

Shoot regeneration: Developing embryos are transferred from rescue medium to germination medium such as Soy ER GSMv2 for approximately 3 to 5 weeks in the light at 24° C. Alternatively, developing embryos may be transferred from rescue medium to elongation medium such as Soy E1 0 No TCV for approximately 3 to 5 weeks in the light at 24° C. Developing shoots may be transferred from media plates to Phytocons containing either germination or elongation medium for further shoot development. Established shoots are moved to soil. Initial plant care is critical for survival of these shoots.

Ploidy Analysis: Ploidy analysis is conducted using a flow cytometer. Leaf tissue for ploidy analysis is collected from small shoots either in culture or after establishment in soil. Tissue is collected on dry ice and stored at −80° C. until analysis, or collected on wet ice and analyzed the same day. A sample size of 0.5 $cm^2$ is sufficient. Samples are prepared according to the instructions in the Sysmex kit. Each sample set contains an untreated F1 plant (not treated to induce chromosome doubling) as a control. The following are method notes: Wide crosses—Our wide cross success rate is significantly higher than that reported in the literature. No emasculation of female flowers is performed, which saves time and reduces risk of damage to the stigma.

Harvest—Pod harvest at 14 to 16 days after pollination (~5 days earlier than literature, reducing timeline)

Embryo rescue—Our embryo rescue protocol involves direct shoot regeneration from embryos, rather than regeneration through embryogenesis, thus making plant recovery quicker (shoot recovery in approximately 2-3 months, compared to reported up to 1 year timeline). Our protocol does not include culture in the dark following transfer to germination medium. Our protocol does not require a transfer to rooting medium.

Chromosome doubling—Have successfully used trifluralin treatment to produce doubled F1 plant: trifluralin treatment can be done immediately following embryo rescue.

Example 4 ASR Resistance Trait Introgression

Amphidiploid lines generated from the wide cross (i.e. *Glycine canescens* or *Glycine clandestina* crossed with

*Glycine max*) followed by embryo rescue as described in Example 3 were backcrossed multiple times with a recurrent elite *Glycine max* lines. It is known in the art that multiple backcrosses are needed to generate fertile hybrid lines, in particular the literature suggests that a BC3 generation is necessary. In this case it was determined that an additional backcrosses are necessary, e.g. BC4 in the case of *G. tomentella*×*G. max* to generate fertile hybrid plants. F1 hybrid plants produced by the methods as described above were created from wide crosses comprising PI440935, PI483193, PI595799 and PI339656. F1 plants were next crossed as a female with a male recurrent *G. max* plant to perform a first backcross (BC1 progeny). BC1 Progeny were further backcrossed for multiple generations (e.g. BC2). BC plants are evaluated for ASR resistance, chromosome numbers and in some cases lines are genotyped through use of molecular markers as described herein to detect the presence of chromosome intervals corresponding to SEQ ID NOs 1-4 or any marker identified in Tables 1-4.

TABLE 1

Exemplary SNPS from Scaffold 56F

| SNP Name | Position (SEQ ID NO: 1) | Favorable Allele (Rust Resistant) | Unfavorable Allele (Rust Susceptible) |
|---|---|---|---|
| 56F | 3046682 | T | C |
| 56F | 3065127 | T | C |
| 56F | 3131652 | C | T |
| 56F | 3159094 | T | C |
| 56F | 3239763 | T | A |
| 56F | 3265198 | T | A |
| 56F | 3383844 | C | A |
| 56F | 3390809 | T | A |
| 56F | 3404306 | G | C |
| 56F | 3410070 | C | T |
| 56F | 3527033 | A | C |

TABLE 2

Exemplary SNPS from Scaffold 90F

| SNP Name | Position (SEQ ID NO: 1) | Favorable Allele (Rust Resistant) | Unfavorable Allele (Rust Susceptible) |
|---|---|---|---|
| 90F | 33235 | A | T |
| 90F | 33551 | T | G |
| 90F | 33556 | T | G |
| 90F | 33586 | G | T |
| 90F | 33738 | C | T |
| 90F | 34016 | T | A |
| 90F | 34054 | A | G |
| 90F | 34299 | C | A |
| 90F | 34696 | C | A |
| 90F | 35273 | G | T |
| 90F | 37176 | C | T |
| 90F | 37222 | A | T |
| 90F | 37838 | G | C |
| 90F | 37841 | C | T |
| 90F | 37989 | G | T |
| 90F | 38358 | C | T |

TABLE 3

Exemplary SNPS from Scaffold 132FF

| SNP Name | Position (SEQ ID NO: 1) | Favorable Allele (Rust Resistant) | Unfavorable Allele (Rust Susceptible) |
|---|---|---|---|
| 000132F | 1036303 | T | G |
| 000132F | 1066085 | T | C |
| 000132F | 1085690 | G | A |
| 000132F | 1088855 | G | A |
| 000132F | 1090029 | C | T |
| 000132F | 1095842 | G | A |
| 000132F | 1104225 | G | A |
| 000132F | 1105287 | A | G |
| 000132F | 1105896 | C | T |
| 000132F | 1130936 | C | T |
| 000132F | 1131612 | G | T |
| 000132F | 1135444 | A | G |
| 000132F | 1147457 | T | G |
| 000132F | 1148939 | G | A |
| 000132F | 1180730 | G | T |
| 000132F | 1233671 | C | T |
| 000132F | 1253344 | T | C |
| 000132F | 1266772 | G | A |
| 000132F | 1276594 | G | C |
| 000132F | 1282394 | G | A |
| 000132F | 1293582 | G | A |
| 000132F | 1340471 | T | C |
| 000132F | 1420388 | T | C |
| 000132F | 1483043 | C | A |
| 000132F | 1501651 | T | G |
| 000132F | 1504883 | C | A |
| 000132F | 1508972 | C | A |
| 000132F | 1564562 | G | T |
| 000132F | 1589089 | A | G |
| 000132F | 1597852 | T | C |
| 000132F | 1607501 | T | A |
| 000132F | 1615924 | A | G |
| 000132F | 1679827 | A | G |
| 000132F | 1694841 | C | T |
| 000132F | 1731209 | T | G |
| 000132F | 1747932 | G | C |
| 000132F | 1749670 | A | G |
| 000132F | 1775700 | T | C |
| 000132F | 1788283 | A | T |
| 000132F | 1792363 | A | G |
| 000132F | 1801200 | A | G |
| 000132F | 1814495 | T | G |
| 000132F | 1817365 | C | A |
| 000132F | 1820064 | T | C |

TABLE 4

Exemplary SNPS from Scaffold 14851

| SNP Name | Position (SEQ ID NO: 1) | Favorable Allele (Rust Resistant) | Unfavorable Allele (Rust Susceptible) |
|---|---|---|---|
| 14851 | 61341 | T | C |
| 14851 | 61461 | G | T |
| 14851 | 91811 | A | G |
| 14851 | 92509 | A | G |
| 14851 | 92510 | T | A |
| 14851 | 116144 | C | A |
| 14851 | 116271 | G | C |
| 14851 | 116676 | G | T |
| 14851 | 118844 | G | A |
| 14851 | 119667 | A | G |
| 14851 | 119964 | C | A |
| 14851 | 120680 | C | G |
| 14851 | 167877 | T | A |
| 14851 | 168709 | C | T |
| 14851 | 169754 | T | G |
| 14851 | 186158 | T | G |
| 14851 | 188346 | A | G |
| 14851 | 189085 | A | T |
| 14851 | 192255 | G | A |
| 14851 | 195663 | A | C |

TABLE 4-continued

| Exemplary SNPS from Scaffold 14851 | | | |
|---|---|---|---|
| SNP Name | Position (SEQ ID NO: 1) | Favorable Allele (Rust Resistant) | Unfavorable Allele (Rust Susceptible) |
| 14851 | 209847 | C | T |
| 14851 | 211195 | G | A |
| 14851 | 212035 | G | A |
| 14851 | 239552 | G | A |
| 14851 | 240480 | G | T |
| 14851 | 240526 | C | T |
| 14851 | 259531 | C | A |
| 14851 | 260142 | C | G |
| 14851 | 261948 | C | T |
| 14851 | 263314 | G | T |
| 14851 | 298445 | T | C |

The SNPS in table 1-4 are provided by way of illustration only. Additional SNPS for the aforementioned PI lines can be found in US Patent Application Nos. 62/881,035 and 62/881,008, which are herein incorporated by reference.

Example 5 Identification of Two Causative Genes Located within Chromosome 14 Intervals Further genotyping of the various *G. canescens* intervals led to the discovery of two causative genes for ASR resistance located on chromosome 14 within the disclosed intervals. The gene type encodes a TIR R-gene motif and is depicted in SEQ ID NOs 7 and 11 for example. It is contemplated that any of these genes or homologs thereof can be employed in a transgenic, gene editing or breeding method utilizing embryo rescue as described above to generate plants having increased resistance to ASR. Additionally, or optionally, polynucleotide sequences having 70-100% sequence identity to these genes (or to SEQ ID Nos 7 and 11) can be employed in the breeding method to generate the above-described plants.

Example 6 Construction of Vectors Comprising R-Genes and Transformation

Gene components cGcaRG3a-01 (TIR-A) and cGcaRG3b-02 (TIR-B) were stacked together in the native form that includes the exons and introns. However, TIR-B was expressed as an N-terminal truncated form whereby the first 90 nucleotides were removed. The transcription of TIR-A and TIR-B were driven by *Medicago truncatula* promoter and terminator sequences prMt51186-03 & tMt51186-01 and prMt12344-02 & tMt12344-01, respectively. These individual gene cassettes were stacked together in binary vector 24217 (FIG. 1).

Features of vector 24217 are described briefly below.

cGcaRG3b-02 (TIR-B). Start: 2226 End: 3955. A soy rust resistance candidate gene *Glycine canescens* PI595799 encoding a protein containing two Toll/Interleukin-1 receptor (TIR) domains. Version 2 is based on an alternative gene model that is 90 bp shorter than version one. The gene is synthetic to Glyma.14G024500 (Soy_william82_v2)

cGcaRG3a-01 (TIR-A). Start: 7499 End: 10058. A soy rust resistance candidate gene *Glycine canescens* PI595799 encoding a protein containing two Toll/Interleukin-1 receptor (TIR) domains. The gene is synthetic to Glyma.14G024400 (Soy_william82_v2).

cmEPSPSpt-29. Start: 13162 End: 14619. Plastid targeted soybean codon modified class 2 *A. tumefaciens* EPSPS with a T273S modification having a glyphosate tolerance Ki higher than dmEPSPS in vitro.

cSpec-03. Start: 15398 End: 16186. Gene encoding the enzyme aminoglycoside 3'adenyltransferase that confers resistance to spectinomycin and streptomycin for maintenance of the vector in *E. coli* and *Agrobacterium.* cVirG-01. Start: 16486 End: 17211.

cRepA-03. Start: 17241 End: 18314.

bNRB-04. Start: 4 End: 143 (Complementary). Right border region of T-DNA of *Agrobacterium tumefaciens* nopaline ti-plasmid.

bNRB-01-01. Start: 101 End: 125 (Complementary). Right Border Repeat bNLB-05. Start: 14989 End: 15118 (Complementary). Left border region of T-DNA of *Agrobacterium tumefaciens* nopaline ti-plasmid. Differs from bNLB-03 by one base pair to remove ATG start codon for ORF pointing into flanking region.

bNLB-01-01. Start: 15024 End: 15048 (Complementary). 25 bp Left border repeat region of T-DNA of *Agrobacterium tumefaciens* nopaline ti-plasmid.

intron1. Start: 2706 End: 3054.

intron2. Start: 3566 End: 3843.

iMt51186-04. Start: 7217 End: 7467. The first intron of the *Medicago truncatula* gene identified.

iGmEF-02. Start: 12233 End: 13141. The first intron of the soybean elongation factor (EF) gene. iGmEF-01 with an internal BamHI site and a 3' end unintended ORF removed.

xTAG-06. Start: 144 End: 183. 40 bp site for plant insert intactness testing and to stop readthrough ORFs.

xSTOPS-01. Start: 184 End: 195. 6-frame stop to minimize unintended ORF read-through.

Start. Start: 2041 End: 2041. The transcription start site based on cDNA/gDNA alignment.

STOP. Start: 3853 End: 3855.

Start. Start: 7080 End: 7080. Transcription start based on cDNA/gDNA alignment.

Stop. Start: 10364 End: 10364. Transcription stop based on cDNA/gDNA alignment.

xSTOPS-01. Start: 11075 End: 11086. 6-frame stop to minimize unintended ORF read-through.

Start. Start: 12170 End: 12170. Transcription start site.

xSTOPS-01. Start: 14620 End: 14631. 6-frame stop to minimize unintended ORF read-through.

xSTOPS-01. Start: 14929 End: 14940. 6-frame stop to minimize unintended ORF read-through.

xTAG-02. Start: 14941 End: 14980. 40 bp site for plant insert intactness testing and to stop readthrough ORFs.

prMt12344-02. Start: 215 End: 2216. The promoter from the *Medicago truncatula* gene.

prMt51186-03. Start: 4984 End: 7488. A promoter from the *Medicago truncatula* gene; different from prMt51186-01 by one bp substitution (pos2374) to remove an 8mer allergen hit.

prGmEF-05. Start: 11087 End: 13152. Translation elongation factor EF-1 alpha/Tu promoter.

prVirG-01. Start: 16281 End: 16411. virG promoter composed of two promoter elements, one responsive to acetosyringone and phosphate-starvation (bp 45 to 83) and another to medium acidification (86 to 128).

oVS1-02. Start: 18357 End: 18761. Origin of replication and partitioning region from plasmid pVS1 of *Pseudomonas*; serves as origin of replication in *Agrobacterium tumefaciens* host.

oCOLE-06. Start: 19439 End: 20245 (Complementary). The ColE1 origin of replication functional in *E. coli* derived from pUC19.

tMt12344-01. Start: 3962 End: 4968. The terminator based on the *Medicago truncatula* gene.

tMt51186-01. Start: 10068 End: 11067. The terminator based on the *Medicago truncatula* gene.

tNOS-05-01. Start: 14654 End: 14906. Synthetic Nopaline synthetase terminator.

u5GmEF-01. Start: 12170 End: 12232. First 5' UTR of the soybean elongation factor (EF) gene.

u5GmEF-02. Start: 13142 End: 13152. Second 5' UTR of the soybean elongation factor (EF) gene.

xPSlp28-03. Start: 13162 End: 13251. Soybean codon optimized plastid transit peptide derived from the *Chlamydomonas reinhardtii* PSI P28 gene.

Transformation and selection of primary soybean events was achieved using *Agrobacterium* with glyphosate as the selection agent (prGmEF-05: cmEPSPSpt-29: tNOS-05-01).

Taqman analysis of these primary soybean events identified three events harboring both the TIR-A and TIR-B gene cassettes with only two events (GVG00885565; GVG00885566) surviving to maturity (Table 2A).

TABLE 2C

TIR-A Assay

| Name | SEQ ID NO: 26 | SEQ ID NO: 27 | SEQ ID NO: 28 |
|---|---|---|---|
| Oligo Type | PRIMER | PRIMER | PROBE |
| Technology Type | TAQ | TAQ | TAQ |
| Nucleotide Sequence | CATTGG AAGCAT CCAGGA TTTC | TTCAAG GCACCA CGAGGA A | ATCGTTG TTCTCTC CAAAAGC TTCGCG |

TABLE 2A

Summary of Taqman analysis (raw data & copy call) conducted on construct 24217 primary soybean events.

| Plant ID | Pedigree | cm EPSPSpt-29 | cm EPSPSpt-29 | cGcaRG3b-02 + tMt12344-01 | cGcaRG3b-02 + tMt12344-01 | cGcaRG3a-01 | cGcaRG3a-01 |
|---|---|---|---|---|---|---|---|
| GVG00885565 | SYDC181509A001A | 1.25 | 1 | 0.92 | 1 | 6.88 | >2 |
| GVG00885566 | SYDC181501A001A | 0.95 | 1 | 0.84 | 1 | 1.09 | 1 |
| GVG00885564 | SYDC181509A002A | 0.52 | 1 | 0.58 | 1 | 1.04 | 1 |

Tables 2B, 2C, and 2D describe probes and primers usable to determine the presence of TIR-A and TIR-B genes, e.g. in a transformed plant or progeny thereof. In some examples they may further be useful for evaluating introgression of TIR-A or TIR-B genes, e.g. through breeding. Accordingly, the current disclosure is also directed to detecting the novel genes disclosed herein in plants, e.g. soybean.

TABLE 2B

TIR-B Assay

| Name | SEQ ID NO: 23 | SEQ ID NO: 24 | SEQ ID NO: 25 |
|---|---|---|---|
| Oligo Type | PRIMER | PRIMER | PROBE |
| Technology Type | TAQ | TAQ | TAQ |
| Nucleotide Sequence | ACCCTC TCATTG GAATCT CTAAAT ATT | GAGTGT ATCCGT GGCAAG TAAGG | AGACAT AGATGC TCCATA GTTACC GCCCTG |

TABLE 2D

TIR-A Assay

| Name | SEQ ID NO: 29 | SEQ ID NO: 30 | SEQ ID NO: 31 |
|---|---|---|---|
| Oligo Type | PRIMER | PRIMER | PROBE |
| Technology Type | TAQ | TAQ | TAQ |
| Nucleotide Sequence | TGTGTG AGAGAG TTTCTT GCTTGA A | TGCACT GGTTAC GTTTTT CTTTAT CT | CCGTCT TAAAGT AATCAA T |

Example 7 Validation of R-Genes Against ASR

Leaves from primary events GVG00885565 and GVG00885566 were placed in a petri dish on moist paper towel then inoculated with a spore suspension of soybean rusts RTP1 or FLQ12. Leaves from wild type soybean plants served as negative controls. After 14 days, these leaves were evaluated for resistance to soybean rust. As shown in FIG. 2, the leaves from GVG00885565 show clear evidence of resistance to soybean rust RTP1 and FLQ12 compared to the wild type control. The leaves from GVG00885566 show partial resistance.

In order to quantify the level of disease resistance, these leaves were sampled for qRT-PCR analysis to quantify the relative expression of soybean rust β-tubulin gene (FIG. 3).

The results from the qRT-PCR analysis show the level of both RTP1 and FLQQ12 rust β-tubulin expression is dramatically reduced in GVG00885565 compared to the wild type control. The event GVG00885566 has only partial resistance. In the same experiment, the relative expression of the TIR-A and TIR-B genes were determined (FIG. 4). These data show both TIR-A and TIR-B genes are expressed in events GVG00885565 and GVG00885566.

Example 8 Stable Transformation with ASR Candidate Gene Vectors

First generation (T1-generation) seeds from event GVG00885565 were sown in 4 inch pots and grown under greenhouse conditions. These seedlings were sampled for Taqman analysis assays to determine the segregation zygosity (homozygous, heterozygous or null) of each T1 seedling. The qRT-PCR analysis of homozygous and heterozygous plants confirmed expression of both TIR-A and TIR-B has been stably inherited from the primary event to the subsequent generation (FIG. 5).

The homozygous and null seedlings were inoculated with a soybean rust spore suspension from three different populations (RTP1; BRO1—Brazil; BRO3—Brazil). At 14 days post inoculation, these plants were rated for soybean rust disease development. The null plants are completely susceptible to all three rust populations while the TIR-A and TIR-BGVG00885565 homozygous plants have a typical red/brown (RB) resistant lesion type with very little sporulation (FIG. 6).

In this same experiment, the leaves of null and homozygous GVG00885565 seedlings were sample for qRT-PCR analysis to determine the relative expression of soybean rust β-tubulin gene. These data show significantly higher level of soybean rust β-tubulin expression in the null plants at 8, 14 and 21 days post inoculation compared to the TIR-A, TIR-B homozygous plants (FIG. 7).

Example 9. Co-Transformation

Primary soybean events were created via co-transformation with two different *Agrobacterium* strains harboring independent binary vectors for TIR-A (construct 24205; SEQ ID NO: 32) and TIR-B (construct 24192; SEQ ID NO: 33) FIGS. 8A and 8B. These independent constructs express the identical gene cassettes used in the molecular stack of construct 24217. The Taqman analysis of the primary soybean events from the co-transformation experiments identified four events with both TIR-A and TIR-B (Table 3A). Expression of both TIR-A and TIR-B was confirmed by qRT-PCR.

TABLE 3A

Summary of Taqman and qRT-PCR analysis of primary soybean events co-transformed with independent binary vectors 24205 and 24192. Note that the qRT-PCR analysis confirms TIR-A and TIR-B genes are expressed in these primary events.

| | cGcaRG3a-01 | cGcaRG3a-01 | cGcaRG3b-02 | cGcaRG3b-02 | qRT-PDR TIR-A | qRT-PCR TIR-B |
|---|---|---|---|---|---|---|
| GVG01173820 | 0.90 | 1 | 2.02 | 2 | 2.34 | 89.4 |
| GVG01173823 | 0.87 | 1 | 3.30 | >2 | 8.74 | 112.17 |
| GVG01174313 | 0.80 | 1 | 0.68 | 1 | 2.41 | 12.49 |
| GVG01175568 | 1.65 | 2 | 1.83 | 2 | 2.79 | 24.87 |
| GVG01175842 | 0.95 | 1 | 11.67 | >2 | 0.27 | 127.15 |

Two of these primary events GVG01173820 and GVG01173823 were assayed for resistance to different soybean rust populations RTP1, BRO1-Brazil and BRO3-Brazil. Leaves were collected and placed in a petri dish with a moist paper towel. The leaves were inoculated with a soybean rust spore suspension. At 14 days post-inoculation, the leaves were sampled for qRT-PCR analysis of soybean rust β-tubulin gene expression. The results show event GVG01173820 has significantly less β-tubulin gene expression versus all three rust populations while GVG01173823 is most resistant to the Brazil rust populations BRO1 and BRO3 (FIG. 9).

Additional Vector Construction Examples

Additional vector constructs are also provided by way of example.

a) 23891 Vector Construction for R-Gene Comprising *G. clandestina* PI339656-Derived TIR-A and TIR-B SED ID NO: 1 corresponds to Vector 23891. FIG. 10 provides an illustration of vector 23891. Features are described below.

1st TIR-. Start: 1868 End: 3892.

2nd TIR-. Start: 5957 End: 8167.

cNtALS-01. Start: 12147 End: 14141. The NtALS DNA fragment encodes an Acetolactate synthase double mutant (P191A, W568L) from *Nicotiana tabacum.* cSpec-03. Start: 15491 End: 16279. A gene encoding the enzyme aminoglycoside 3'adenyltransferase that confers resistance to spectinomycin and streptomycin for maintenance of the vector in *E. coli* and *Agrobacterium.* cVirG-01. Start: 16579 End: 17304.

cRepA-03. Start: 17334 End: 18407.

bNRB-04. Start: 4 End: 143 (Complementary). Right border region of T-DNA of *Agrobacterium tumefaciens* nopaline ti-plasmid.

bNRB-01-01. Start: 101 End: 125 (Complementary).

bNLB-05. Start: 15082 End: 15211 (Complementary). Left border region of T-DNA of *Agrobacterium tumefaciens* nopaline ti-plasmid. Differs from bNLB-03 by one base pair to remove ATG start codon for ORF pointing into flanking region.

bNLB-01-01. Start: 15117 End: 15141 (Complementary). 25 bp Left border repeat region of T-DNA of *Agrobacterium tumefaciens* nopaline ti-plasmid.

iGmEF-02. Start: 11216 End: 12124. The first intron of the soybean elongation factor (EF) gene. iGmEF-01 with an internal BamHI site and a 3' end unintended ORF removed.

gGcIRG6b-01. Start: 217 End: 4834. A genomic fragment derived from *Glycine clandestina* PI339656 sequence harboring a soy rust resistance gene that encodes a protein containing two Toll Interleukin-like receptor (TIR) domains synthetic to Glyma.14G024500 (Soy_william82_v2).

gGcIRG6a-01. Start: 4842 End: 10050. A genomic fragment derived from *Glycine clandestina* PI339656 sequence harboring a soy rust resistance gene that encodes a protein containing two Toll Interleukin-like receptor (TIR) domains synthetic to Glyma.14G024400 (Soy_william82_v2).

xTAG-06. Start: 144 End: 183.

xSTOPS-01. Start: 184 End: 195.

START. Start: 1868 End: 1870.

STOPS. Start: 3890 End: 3892.

START. Start: 5957 End: 5959.

STOP. Start: 8165 End: 8167.

xSTOPS-01. Start: 10058 End: 10069.

Start. Start: 11153 End: 11153.

xSTOPS-01. Start: 14946 End: 14957.

xSTOPS-01. Start: 15022 End: 15033.

xTAG-02. Start: 15034 End: 15073 promoter. Start: 217 End: 1867.

Promoter. Start: 4842 End: 5956.

prGmEF-02. Start: 10058 End: 12135. Translation elongation factor EF-1 alpha/Tu promoter, including the first intron and neighboring utr, from soybean (williams 82). Like prGmEF-01, but remove internal NcoI, BamHI and SanDI sites, multi-frame stop codons added at the 5' end and one unintended ORF removed at the 3' end.

prVirG-01. Start: 16374 End: 16504.

oVS1-02. Start: 18450 End: 18854.

oCOLE-06. Start: 19532 End: 20338 (Complementary). The ColE1 origin of replication functional in *E. coli* derived from pUC19.

Terminator. Start: 3893 End: 4834.

Terminator. Start: 8168 End: 10050.

tGmEPSPS-02. Start: 14148 End: 14957. Modified version of tGMEPS-01; an EPSPS terminator from *Glycine max.* u5GmEF-01. Start: 11153 End: 11215. 5' UTR of the soybean elongation factor (EF) gene, before intron.

u5GmEF-02. Start: 12125 End: 12135. 5' UTR of the soybean elongation factor (EF) gene, after intron.

The above examples clearly illustrate the advantages of various embodiments of the invention. Although the present invention has been described with reference to specific details of certain embodiments thereof, it is not intended that such details should be regarded as limitations upon the scope of the invention except as and to the extent that they are included in the accompanying claims.

Throughout this application, various patents, patent publications and non-patent publications are referenced. The disclosures of these patents, patent publications and non-patent publications in their entireties are incorporated by reference herein into this application in order to more fully describe the state of the art to which this invention pertains.

---

SEQUENCE LISTING (33 sequences)

SEQ ID NO: 1 - DNA, 3814980 bp, Glycine canescens (residues 1-1,907,490 of 3,814,980)
cctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaacctaaaccctaaaccctaaaccctaaaccctaaacctaaaccctaaaccctaaaccctaaacctaaacctaaaccctaaaccctaaacctaaaccctaaaccctaaccaccctaaaccctaaaccctaaaccctaaaccctaaaccctaaaccctaaaccctaaaccctaaaccctaaaccctaaaccctaaaccctaaaccctaaaccctaaaccctaaccctaaaccctaaaccctaaaccctaaaccctaaaccctaaaccctaaaccctaaaccctaaaaccctaaaccctaaaccctaaaccctaaacctaaaccctaaaccctaaaccctaaaccctaaaccctaaaccctaaaccctaaaccctaaaccctaaaccctaaaccctaaaccctaaaccctaaaccctaaacccactaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaaccctaaaccctaaaccctaaaccctaaaccctaaaccctaaaccctaaaccctaaaccctaaaccctaaaccctaaaccctaaaccctaaaccctaaaccctaaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaaccctaaaccctaaaccctaaaccctaaaccctaaaccctaaaccctaaaccctaaaccctaaacccctaaaccctaaaccctaaaaccctaaaccctaaaaccctaaaccctaaacccctaaaccctaaaccctaaacctaaaccctaaacctaaaaccctaaaccctaaacccctaaaccctaaaccctaaaccctaaaccctaaaccctaaaccctaaacccctaaaccctaaaccctaaaaccctaaaccctaaaccctaaaccctaaaaccctaaaccctaaaccctaaaccctaaacctaaaccctaaaccctaaaccctaaaccctaaacccctaaaccctaaaccctaaaccctaaaccctaaaccctaaaccctaaaccctaaacccaaaccctaaaccctaaaccctaaaccctaaaaccctaaaccctaaaccctaaaccctaaaccctaaaccctaaaccctaaaccctaaaccctaaaccctaaaccctaaaccctaaaccctaaaccctaaacccctaaaccccctaaaaccctaaaccctaaaccctaaaccctaaaccctaaaaccctaaaccctaaacctaaaccctaaaccctaaaccctaaaccctaaacctaaaccctaaaccctaaaccctaaaccctaaaccctaaaccctaaacccttaaaccctaaaccctaaaccctaaacccaaccctaaaccctaaaccctaaccctaaaccctaaaccctaaaccctaaaccctaaaccctaaaccctaaaaccctaaaccctaaaccctaaaaccctaaaccctaaaccctaaaccctaaacccactaaaccctaaaccctaaaccctaaaccctaaacccctaaaccctaaaccctaaaccctaaaccctaaaccctaaaccctaaaccctaaaccctaaaccctaaaccctaaaccctaaaccctaaaccctaaaccctaaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaacccttaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaacctaaaccctaaaccctaaaccctaaaccctaaaccctaaaccctaaaccctaaaccctaaaccctaaacccctaaaccctaaaccctaaaccctaaaccctaaaccctaaaccctaaaccctaaaaccctaaaccctaaaccctaaaccctaaaccctaaaccctaaaccctaaaccctaaaccctaaaccctaaaaccctaaaccctaaaccctaaacccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaaccctaaaccctaaaccctaaaccctaaaccctaacctaaaccctaaaccctaaaccctaaaccctaaaccctaaaccctaaaccctaaaccctaaaccctaaaccctaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaccctaaaccctaaaccctaaaccctaaaccctaaacctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaccctaaaccctaaaccctaaaccctaaccctaaaccctaaaccctaaaccctaaaccctaacctaaaccctaaaccctaaaccctaaaccctaaaccctaaaccctaaaccctaaaccctaaaccctaaaccctaaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctacctaaaccctaaaccctaaaccctaaaccctaaaccctaaaccctaaaccctaaaccctaaaccctaaaccctaaaccctaaaccctaaaccctaaaccctaaaccctaaaccctaaaaccctaaaccctaaaccctaaaccctaaaaccctaaaccctaaaccctaaaccctaaaccccctaaaccctaaaccctaaaccctaaaccctaaaccctaaaccctaaaccctaaccctaaaccctaaacccctaaaccctaaacccctaaaaccctaaaccctaaaccctaaaccctaaaccctaaaaccctaaaccctaaaccctaaaccctaaaccctaaaccctaaaccctaaaaccctaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaaccctaaccctaaaccctaaaccctaaaccctaaaccctaaaccctaaaccctaaaccctaaaccctaaaccctaaaccctaaaccctaaaccctaaaccctaaaccctaaacccctaccctaaaccctaaaccctaaaccctaaaccctaaaccctaaaccctaaaccctaaacccctaaaccctactaaaccctaaaccctaaaccctaaacctaaaccctaaaccctaaaccctaaaccctaaaccctaaaccctaaaccctaaaccctaaaccctaaacccctaaaccctaaactaaccctaaaccctaaaccctaaaccctaaacccctaaaccctaaccctaaaccctaaaccctaaaccctaaaaccctaaaccctaaaccctaaccctaaaccctaaacccctaacccctaaaccctaaaccctaaacccctaaacccaaacccctaaaccctaaccctaaaccctaaaccctaaccctaaaccctaaaccctaaacctaaaccctaaaccctaaccctaaccctaaaccctaaaccctaaaccctaaaccctaaccaaaccctaaaccctaaaccctaaaccctaaaccctaaacccctaaaccccctaaaccctaaaccctaaaccctaaaccctaaacctaaaccctaaaccctaaaccctaaaccctaaaccctaaccctaaccctaaaccctaaaccctaaaccctaaaccctaaaccctaaaaccctaaaccctaaaccctaaaccctaaaccctaaaccctaaccctaaaccctaaaccctaaaccctaaaccctaaaccctaaaccctaaaccctaaaccctaaaccctaaaccctaaaccctaaaccctaaaccctaaaccctaaaccctaaaccctaaacctaaaccctaaaccctaaaccctaaaccctaaaccctaaaccctaaaccctaaccctaaaccctaaacccctaaaccctaaaccctaaaccctaaaccctaaaccctaaaccctaaaccctaaccctaaaccctaaaccctaaaccctaaccctaaaccctaaaccctaaaccctaaaccctaaccctaaaccctaaaccctaaacccaaacccaaacctaaccccaaacccaaaccccaaacccaaacccaaacccaaacccaaacccccaaccccaaaccccaaccccaaaccccaaaccccaaacccaaccccccccaccccaaaaccccaaccccaaaccccaaacccccaaaccccccccaaaccccaaaccccaaacccccccaacccaacccaaccccaaaccccaaacccaaaaccccaaaccccaaacccccaaccccaaccccaacccaacccaaaccccaaacccaaacccaaaccccaaaccccaaaccccaaaccccaaaccccaaccccaaacccaacccaaaccctaaaccccaaaccctaaaccccaaacccctaaacccaaaccccaaaccccaaaccccaaaccccaaacccaaaccccaaccccaaacccaaaccccaaaccccaaaccccaaaccccaaaaccccaaaccccaaaccccaaaccccaaaccccaaaccccaaaccccaaaccccaaaccccaaaccccaaaccccaaaccccaaaccccaaaccccaaaccccaaaccccaaaccccaaccccaaaccccaaaccccaaccccaagccccaaaccccaagccccaaaccccaagccccaaacccaagccccaagccccaagccccaagccccaagccccaacccaagccccaagcccaagccccaagccccaagccccaagccccaagccccaagccccaagccccccaagccccaagccccaagcccaagccccaaccccaagccccaagcccccgagccccaagccccgaaccccaagccccgaacccccaagccccaagcccgaaccccgaaccccgaacccgaacccccaacccgaaccccgaacccccaaccccgaacccgaacccccaaccccgaaccgcaacccccaaccccgaaccccccaacccccaccccgaacccgcaaccccgaaccccgaccccgcaaccccgaaccccgaacccccaaccccgaaccccgacccgcaacccccgaaccccgaaccccccaaccccgaaccccgaaccccccaacccgaaccccgacccccaacccaaaacccccaaccccccaaccccaaacccccgaaccccccaaccccaaaacccccgaaccccccaacccgaaacccccgaaaccccgaaccccgaaaccccgaaccccgaaccccgaaccccgaaaccccgaaaccccgaaaccccgaaaccccgaaccccgaaacccccgaaccccgaaaccccgaaaccgcgaaaccccgaaaccccgaaaccccgaaccccgaaccccaaaccgcgaaaccccgaaaccccgaaaccccgaaacccgaaccccgaaaccccgaaaccccgaaaccccgaaacccgaaccccgaaaccccgaaaccccgaaaccccgaaacccgaaaccccgaaccccgaaacccgaaaccccgaaaccccgaaccccgaaccccgaaccccgaacccccaaacccaaaccccgaacccctaaaccctaatttccccctaagtatttaaaaaagaaactacaaacttgtattaaaagttaagaaaatactgtctcaacttgtcagtgatttctgttttcctgggttcatcatccgacccataagagatacaatatcttgtccccctttaggtcgtgcattggcagccagatcatgtagggttacatccttaagaacaacaatccaaatctatcaaatatatatagtatactcaatgtcagaacaggttcttatagagtgcactaaatacaagcctttgattaaaacaatcaaatatttaatatatcaatcaaatttcaataaaaaaaatggaaattaatatttaatgtatatttatattttatcaatattttattctaactacatacattaaaataatttttattatatatctatacaaaaattattttttttaaagttaaaattttcaattaaaccaaatttattaatctgaaacaagcaataaatatttcaatttatattgttcttatgttctataattatagttccgtttatttccaatttcttcttccttgttttttgttggtaaaaattacattatgttgaatctgatgcatggccttttgaacctacacagatattattgatctggtgtcttacagatctattcaaatttgtttattgcctaaactaacttttaagctgattaggaaaagtattattattcttaaattactgaactttggtggccagatgatgggaagggttttgtttcaatttttggatcaggagtctgagtgatatgtggttgtaccacttggaaaacgaataataaagattgaagagtactgaaacagaatacggatacagaacatatgttgagattttcctgaggagaatgtccagtgcattttatgaccaagtgtattgatgtcttgtacatattagtggtatgagatacactaaaccctacaccccacaccccaaaccccaaaaaaaccaaaaaccctaaccctaaaaatgtcaaacccccaaatcccataccccaaaaccccaaaacccccaaaccccaaacatatcaaatatcataattcaggtttatcaatagaggaaacacagctcgatacactaattgttacaaattatacttaccacttccttcccacatcatctgatgtctttgtcaaatgaacttagtagtatagtaacactcctaaacaggatatacatcatataatcatatctcgggaaatcctatcccaaagcacaactattatctttactctcaacaacagtatccctagccaaaaatatctacacaatcatgcaaaagaacaaatcaatgaatcttaacaaaaagaaaaaataagagcaaaaagtcagtaaatgagaaaaaccaatatagcataaatacatacgtaaagcacctgggatagatgtagtcactattgtgttacagttcacaaaacattgtacacttccctatatataaccaatgactaaaattcacatatgcacattttttcaatatcattagatggaagcatatttttttctagttggaaagcctcattttcaaataaagcaaacagagcagcataaaatctagaaatttgaaccaaagttatcagaaatgtaaaggttttttattcatattgtacaatttaattatattctcaaaaacatcaattcatgtcatcaatacaaatctgggaagacacaaattgtggctagacaagattgaggattctactagtgcatcatccagataaagcccacatcagttatggtcctgtattgacccaaatgagaaaatccacctattttcacaaactttgttgaggtgacgacaacagcaaagatatttaattgattttcttatatggtggcatccctcattttgagccaaattttatgaagattgagttttctagaaacaaaaattctttcaatgtttgtcacttataaggatatagtaagaaattgcagcagcaagcatttaagtatattgaacagtatccatatcaagttattaaaattgagtactgaaacaactagaaaatgattagtgttcaggtaagaaaggagaaaagagactcagaataagaggataccaaattgttgtggtatattatgattcaacacaaaaaaaaaaaacagaacattaaaccccattagtgatagtactagctaatagtattaatcataaagaaatattataaaatctagaaaaaactacttagaaatcatacgaataaagatattcagatatacacaggaccaaacattctagcataaacataaaatttgaacaattacagagtatttgattaaacactcaaaaaaagacctttgaatcacaagacaatgattataataatgaagtaccttgcttgcaagtagaaaaaaagtggccattgaaccagaggaagatccccagaattcctaggcattaaaagcaactccatttcgctgtgagcaaggaaaacatgaccattcaggtattaattaagaaggaaagaagaaagataaataaaaccaagaaaatgtatagccgcttccatgactaacaagttggttacataatcctcctcccttagatttcttatgatctcattccaaaagggggcaaaccgagcagcatcaaccttgttattcttccaacctttggatgaagagtaattgaataagtaatatttactcaagtttaaaacaaatgttcagcaaacatgagaccagtgtactgtaaccttcccatcaacataaaaagtttcttattttagtgttagtacacaggtatcaagcaaataaacatgaatttagaccaaattatgtcttcctttatctatagcaaaaggctgacctgaacagacgactgatgggaactcctgaaaatataaaaattgagaaaaactatataagcttatacaaaaaaagtactatttaaggggaaaatctgaaagaagagaggatatattctcagagagctacaacagagataggacacatacatatacaattatcttccaaaaatacagaatgaagatcataaaacagaaaaagcacatttcacaagcagcacctttgggtagaggaacatgaagtgtgtccataaaagctccaggaaactgctcaaaaagtttgtgcagtgcttccaatgacctaatctggtgaccgcatacaaccacaaaaaaaagttatgccaactaatcttaaattcttaaatatacaggacaagtgtgtaaaacacataaatatctagaagataaatctgaaagaatgggaattaacaaatcggaaacagccatcaaaacactcaaaaatgggagggggaagcaattttacaaaacagttaaattgaaggtttttccatcacctaaaagcttttatactatttattaactactaaaccagtgaaatacaaccctcaatactaagttcagcaactcctgaagatataatacgcttacttggggacttcttactccagctgttccaagagtctccgctagtggaaccccgtctaatattttcaaactcctgaagatgtcatttttaaatgctcaaacaagagatttttgctgcaaacttttattgaatgcaaataaagctaaatccaaaaaagctatgaaactgcatgcataacagactatattaacaaccctaccactatacagcaaactttaaggacctcttgtcagacattcttccccattgacaaagacagattaaaaaggaacaacatatcctccttttatgattaaaatatttaaagaacggggaagaggtaaacaaacaatgaaactatacttacagcaaccacaggagtccacacgctaacaactttcaaagtcactgattattttaatctagttattatgaaatattttctcacattacaaatatgtatgaagtttgtaagaaataacacaagatttaagtgacacaattgcaaaactcttcacttgttgtatatattataaaagcataatatagcactcgagttggaaattttaaaactgatcataattttaaaaaagggatgaccgatgaccattcctcattttcatcaattcaagatagagctttgtttcacatggaaagaagcaagttcttgacagaaaattgaattcaatgtcatgaaggaactcaacaaacaggcaacaataactatttttcttggatcaattctttcatttgtaaaatttggccaacctttccttcccctcgaaaccctaagacccaaagaaaacctaatgcaaatcacatgcatgtcatgtagcgtttctttaatgtaattgtaatcacagagagacaaataaggccaacaagcagttatagattatttaaaggaaatgaaaggaaataacagaccggaagaagaggagttgttgtcatgattgttcttccccaaggcgctgacaacaaatgggcgataccctttagagtaagggtttctcctcaaaacagtgatctgaaacactttgctccttcccaaattgaagggaatgggtctgtggcaaaacgaatttgtgtggaaaaggttctttgcatgaacagcaaacagatccattctcacttttttactgcctttatcgtttctggatcgatgacaaacggctaagctaagaagcgagaaggatagaattggaaaaacaattttagaaaaataaagatagtaagtggagcaacaacagaagacgatcaccaagaggatgaagaaagacactagtacgattatgaaaacgacgctttggaattggaaagagtgagaatatgctttatttaaaccgaattgtgtggaggtcagcactggcgtacgttagccacaacctcctatgcgatctaaaattgcactggcaaagataagattaatctaatctgattgcttgccaatagttacctatccattcctctctccaatagttacatatccattcctctctctccaaatcagttaactgaattcaactgaccttaatctaatctggtgggttgtaaattgagttaaattgattaatcattcttttttttttggaaaaaaataaatatctcgtaaattcagtcattcattaaataaataaataatttaaacataatatcatagtcacaaaaatatttcgttattatattattttatcacaactattatttttttaaataggggtattatcatcacaagttaaataaacttaaaataaaataataaaataacatgaaaatactcttatgtgattcttattataagacaaatttaaaatgaattgatgaattttttataaggcatttcacaattcttatgtaatatttaatttttattaattgttattattaaatatttttttcatgtcttaaatataaacaacacaaatttcttattttttatttgaaatataaacaaatcttaacttataaagtcttatttaatgatattatacttagaatatcctttatttaatatagttagccttttttatgtttaatattaaatttcaatgaaagattgcttaagaaaaaatattattttttagagaaatgataggaacaccatcactcattgacacacattttactcattggctggaatttattgaaaataaaaaatctgataggtctcacatcacatttaatggttatcttgattttataattttcaataaattttcatcaattatagagtgtttgaagtagtgtgttagagagagtgtttctaatatttttctattttttaattagaatgacataatttaatgaagttcactaatttcctaaataagtgtaaaacatgtctttttcttcttataatcaagactcaagagtcgagagagtatttgtacttgttattggtggtgattcacgactcttagactttaatattttcgcatcactcataacaagttaatgattattaataaggataaaattgatacattagtagtatttattttaaaagtcaataaaatgaattacataaattatttttattgatttgtgtgattatctccaaaggacctagggggtaattcacaaaatatcatgtccaatgagttctccagggatattttggtgcaaaaaaagtgttgttttgcctcaaaaaccaccaaatgggtgggatggaggtggtaaaaacaatgtcatgtttaaagataaaatgacggggctcaagtggaccttccaaggagggaagaagtgaatttgatagtaaataacatattcataattgagtttgaagagggagatcatatgaagccttagtttcttcatgatgcatggtaggttgaaaacaatatggaaattgacagacaattttgaagtggtggatgtagggcacaatttttacatggtgtagtttgatcttttgcaatatagggaaaatgtgattagcaggggtcaataactggtctaccatcaatgcataaactcacttgtagagtaacatcttccaaggtaagcaacatgaaccaattattgaagtcagattgaacatgttttcttaatgaaatgacggtctatgccaatgtgcttggatctctcttggaaattggatatcaaattgtatagttaatttctaataactcacaatacactgtaattccaaccacataatttcataagaattatttagtaaaagggattgcctaagaatatctgtaatagcaataatttaaaattttggtatacaaatctttttaagtctttttcacattagtattttagatttattaactatttgtatccttttatgaatacattcaaactccacatatctagatttcccccaaaatttccatagagttttgtaagactgagaagatggcgaagagatgtcttgtccttttcttgatcatagtctaaacctatatttgtccaatggatccttatgacttttttaaaagcgtttttggcatgtttgatccatccaaaaatcttattaagtctatagtaagacatattatttctcctttcagttttaagacttcaaataaataatcaatcttatcaattactttagctctttcaagactttcttctaaagtcttaacctttttctcaaaaatcatagttgtttctttagagaaatattttcacaaacaacttgtactttctttatacttatattccacaaaaatcatatgtgtgttttgaagaacatcataagccattgcctcatcatttgataaagattcagatgaactactactatcagactcaaaaaagttcttacttatcatttattgattcactcgatgcgctcttaaacttgtccatgtgtgctttgaggaaggctttttcttttcaaatttttcgtctttcttgattggactctccaaccttcaaactatgattttttagtattttcaacattcaaactataagatttaagaaaataaattgtgagaaatggattaatttcaaaagagttactcttagataaacttaatccatcctttattattattattattccctccaatgattctaataagtagttaatattacccattgaacaggaaaaagttttcaatggtaagtgatagacatatacaatagaaacttgtttttgttttaaggggcatttttatcactaaaaaataacaactttgaggggagtttaatagcaatggaggatggaaatagcaaaagatgaatagcaaagtccatcaagaattctcctactctgcaaaatttattttggatatgtttttgggtatcttaagagacagaaacattatgtttttagtaatgatcatatttgggtaagtatttgccgctagttcttgtcttttcaccaatattttgttttatattaataggtgttggtatgatgctacttgtaattaagttttatgcaacaatccttgcccattttgtgcttggatttgactattaataattatacatttataagagaagaaaagtaaatttgaattatttaattttgggagaggatcacaggttcattttttaatataatgacttattgcttgctaaaattttcttattttctttattattattagtctttagaaaacattgaataatttaggtaatgaacaaaactcattggcctatttgggctcattggcctgtttaagcctataggtctattgacttgtttatagacccttatatagaagcaaactttcaagtcagaccagacttttaaacaggtcaattaagacttaaaaaaatacatgtaataagtaaataagtcaggctcagacttagtaattatgatgtaaatcaagttcagacctttcaaagcctgatcaaagtctgacctaacctatttccacctttacttacatctaaatcaggagaatgaatcattaatgagatgtgagacccaccaaaatatattgtaactcagaatagaagaaaaccaacaaattcatctgaagatccctgattttttcttctatttgttaacaggcccgagaagttaatagtacaattaataacttattgagaaatgaaatattcaatcagattacaggattagaaaacacagaagcacaaacattatatttaaacatggaccacgataaactacacaaaggttattaacataccctaagaggaatcaaaatggacagataggcatacattaaaaccctttgcaatcagggcagtcactcttttaaactaaatcttgcattttgaacctttactgatagctttaacttctgttcttccatatcctttagcaagccagcaagtttgctctataaacttcacatcgttgatttgtgacctctaactcagcagtcaactctcggattttcttttgcttctcggcctgttgcataggatccaaagggaatttgtttataataccacgtgtattaacaaaaatacaggccacatattgttaaaaatcagatacggataaattgaaataataatttcttattcattcactcactcattcatccattcattcactcatccatcacctcttaaatgaggaatatttatacaagtaatgttaacatcctgagcacaatattaggaaacaataatttaaacttattcttatctagactattttaacaacctgttcctatctaagagaaacaataattcaaattcaaattctatattcaacacatataggaagatgttgtcagttctcactctaatgtgtacgcttaggaaaatccaaatacacataaattttgtgccataattctataaaataattagtgaaaaggaaactttatatatagcataatgttaaaaacttagcaagatgagcacaaatataatccatgaaaacagcctcaattttaagaggttcaatttaaacttacaggctaagcaaattcaatttcttaaattactggagaagatgagaaaaaaagatcaccatggtcatagaagttgcagaagtccatcatagacaaacaagcacgttataaccacaacataagcaatacagattcttcacataaaatagtataaatagcacatatttttcaagggaaaattacaatcagcctcttaaactttgaaccttttgcaaaatggcaccaccaacgttaaatttgtcccaatctattaactttaaaaaatattacaatagacccttctgtttagctaccatttaaccacaagggaagagctacgtgacatctaattcattcattttatgaaaaatctctttgttttaaaatataatttacgaggtttttaaataatcatcaatttaaaaaatagtaagtggcatcgagtccaaccaccatgccacaacatcaccaaacagtaaccatgtaccacaaaaatcttgcacaaaaataaatgagacagagacagagaaatctataatgcattaatcctaaaccatcactcaccatcaccaccacccactgtcaccagccagaacataggttaaaatcaagatgcaacctgtctacaactgcatgcacaccaaagcatagctccccaaccaaaatgtgcaaacccactaattctagagatttgatcatcaaagtgatatttacctcttcctaattcaatcttcccagtttttgacaaatatattagatttcacaatttacttgggtttttgtgtaaaaagataattgtgtttttctaatttatgaacatttattaaataaacaaataaagcagaaaaaaatggattgtgaggatttggcgatcatggatggatagtcttttgacatgtcatcaagtgttcacatggtaagcacacctctgtaatgagttaaaggatgctataaaaaacaaaaggatttactggcatatgagaaatactagcaacacactaacattttctttccaacaaactctttataaggtagaattcatgttggtcccactaaatatgttggtcacatccccaaactagtagaactcacatgcagttcaactaatatgagagagtcttaagaagaaagtattagagaatatattgctagtttttttttttttttttacagccaataaaaagagattatattaaaaaaaaggtacaaggggtaccctaacccacatacaaatttgcataacagggccaaacaaaaagccaatcaaattgcacaagatattatcccttcccatcccaacgatcagcaataaatacccatctataagattccccaacattaaatgtctcattcaattatcatagcgttaacattgcagcccacaaaaacccaaggagaatacattgctagtattcctcattggtatattatgtaaagtttaaggattaattgagacaagtttaaagttggtggtagcaatttgaagaagatcaaacataaatgttatttacttaccacattgaaaagcattacctagaaaacaacaagcatgatttccaagtgccagcttggaggttgtacgcggggggaattgccccttccttttgtacattatttttttttgcttcaacacaaaaacatgtacagtaatagtatagttccttggatgcagctcattgtagaatttgccagggaaagactttgtgtacataattgttctagtgagaacctaatggctttatcatctaaggaaaagatcttaagttcaaagaaactaaccacagattgattgcttggaacatcttcatctgctacaagcaattcacccctgcttccattggttactatagctccctctgctgttccagaactctgattttttattgcgcaaaccttcttagcagcttcttgcagagctctcatggcaacatgatagatttggattgattttgcaccttcttcaacatatttgattgcttcttggcgtaaattgttataacaaactgttacagactcacgagaagtacttggcaattcagatgcatgttcatctaacaatgtaccggttttagcattccttgtccagcgtgtcaatacatactgagatggaagagtaagaacatttttagctctgaagactgacagtatatgcctacaaataattcctgaatattcaaacatctgacaactgcaactagctttcgtctcaaaagaattaaaagtcacaacatgagatttttggttttccccaaatttggcaactcgatatgtagtgattgtttctgaatcatcaatttttgtagcaggatttgcaagagtctctactaactcctcttggaatttcatgaatatctttctcgtgtaaagacccgcagcttgtttttccataggagatggtgtttttaaaactggactactattagtagtgtcataatctgcttttaattctctttcatgccaacttgacacagctttctcgtattgtctaaccaatacctgtagagtggtggatgaattcacatatccatcaaagaaagaattcaaatattcattttcctcattcaaagatatctctccaaagaaagtctcccgcaagtacacatgaacccaatgttgtcgtgcgctgtacattgactgaagccattcattgtccatgacgtagaatctttccaagagtgagtgccaataagactcaaactcatcaatagtctcactttcttgaacgcatttcttgaattcagtttcaaaagcaggatgtgactgacataaatgagccagtttgcctcgggtttctctgaatatgctccatttacaaaaccgatggcgagttgaagggagaacttgggcaacagcaacttgtatgaaagggtccaaatctgttgtaatagagacagggtggccgccagacatggcatgaagccaagtcctgaatagccatataaatgacaattcagattcattgaaaatcaatgcgcaaccaaataacacaggttgcccatgatgattcaacccagtgaaagaggtaaatggaacccggcatcggttagtcttgtaggttgtgtccaatataacagcatctccaaaataagagtagtttgttctagatgttgcatcagcccaaaatatattcccacacgcgagattattgtcatcctggactgcataaaagaaagcaggattatctgcctgcatgcgcttcaagtagtccaatacatgatgacccccaccaccaagggtacgctgtctagtgatactcatttgtgctgtaagggacgaggggaattatgatcaggattataccaaatatggtgggttgacatgttacagagtcaacctacctaaattttttaaacaaaatccataaattaatgctgaaaaggtaatcaattgagaacttcaaactcataagtcataatgaaatggcaaagattctgtgaccctgctatgtctaactaatcccattacgttagagacgaatgtgaagaacaatactatatttttaatgactaatgcaatgatattactataaagcagattatcaacttacatagaactcacatagataacacaattagccagacatatataggttcaatataagctgggcctcatttttttttaaagaaaaaaattatagttaaaatctacaacatgtgatatacagatgcagcttacaacccctttctatgaacacgaaaactctaatatactaaataatcaacaacataaataattttctgaaatatttcttctgtacgcgaagaaccaataattggagcaactaaacaagaacaagtaaacagcccagaaattattatttaaaaattacggtcacagcggctgttgggggtggagtcgcgacggtgcaagctcgcaaatgggtgacaagaggtagcgtcccgaccaagtgactgactgcggtggcgtcgtgggcgtctgctggatgtgctcgcgatagctttctttcttaacggctgaccgcccggtggctgagagagcaaggcgtgagggagggggagagggagagttgggacttgggaggaggtcgtgcggctgaactgagttgacaactgtgaggtccgggaaaggtaaaggatgtgttttatttgatttgatctgatttgagcaattttgattatgattattaatgaaacaaagacactcgactcccacttgaaagtcacttatatatatagtttgaatgtaacttatttaaaaaaaatgtaattattatcgttgaaagttaaaataaaatattatgataataaattgagaataaaaacatccaaaaaaagatgacatcaaatataattatttcatttataataattataaattagggtatgaaaagatgaaggggatacatattatttaaacaaaggttttttatattgtcaaatttattaagaagggtaaataaacattatgatgttgaatttgtaaatttgtgataatttaatttatgaaaaatcaaaatttaaatttagttaatgtgtgataattacacctcatttttagttttatgacttatgagaccatttttgtcattaagcaatagttttaaaacaccaatttaatattaagttatattttttaatattaatttgaaattaagttaaaaaaataaaaattattttaagatgttctctctcctttatcgttgggatgaaaataggtcgaccacctataaggagctttgacctgacctgacctgacttgtttattataaagttcaggctaagactttttgaaaagtctgtttacataaaaaggtcatgcttaagcttttaaaaaaaatttttaggtctatcaggttgacctaattaatatatatatatatatatatattaaaacttaaaaataatatatttatttttctaaaaatataaatttccttattatgaaggtggatgatcaatcacttcaaaaatcaccttgaaaatcccataaaatgatcattacttatttgaaaatataagtaagatgttgagacattttctatttgaaaattgtttatttaactttcctaaattgatttaaagtgttttataaaattaattttcttattaaaaataggctttttaataggcttgtaggtcaaattaggcttttaaataggtcagaccaagcttaaaaaaaatcctatgacaggtaaataggttaggccaagctttatgtttttaaatcaggcctaaccaagtctggtcttgtctgacctgtttccacccctatttgtcgtggacacgagctaatcctgtgacctaaacctcatcatgatctcatgggaagagcttgtgtgtcaccaccaacttcttttcacaccaaattgtcaacgacatatcttcgattgtagaaaatcgtataacaaatccacaacatagtccctaacttccaattctcacgccatcaaaagtgaaatcctcaagttccaagaatcaaaatatccctcttgttttagaaccaccaacctccctccacaaattctctttgcaaaccttaagcaaaaatcactagctaaatcaaattcctttccaaaacactctatgacaccatttcaacacccttctttaccgtcatcttctcaatgcaaaatcgttttaacaattccaaaaagaaaccccaaatagagagaaaaggtgtaggatttggttaaggttacaatgttgacaaccagccaattgaaatgggttgggtatgccatgcggaacatgagccaaaaaagaaagtgttggtttggtgttttttttttttttgtctttttttctttcaaaaatgggtattgttagatgtggatggaaggtttggggaagaagatgggaccagtgaacgttaagtagcttttgatgaggaagataaattttaaaatattaataaaagagcatgtggcggccaaaaattgtcattatatgtaaattgattataataaatttaaatataatgacattttttagccttctttcgggtggttggatgttcttgatttttgattttcaaatggatttttcaatacaaaacgtgtttaacaaaaataaagttgaaataatttttaactcattttcaaaacacttttacattcattttgaaaatcaagatttttttttttgtgaatttgatttttagtttaaaaaaaaaatacaccttctttgcatttggcaatgactttttctattgccaccatcatcatcattgacactattatttggaacaccctaaaatcttttccataagattgataaacacccaagtattatttgatcattaaatcattcttgacttttcaaacaatagtttgatgaaatataattcaaatcaattgttacatagaggatatacaattaagaacatattccaaagaaatttaaaaaaaaaggattgcacattaaacacttgtgtatgaccatccaaagacttgtaacaaagcaaagacaaagcttgatttttcacaaattcaaaagtcttatatgttgtgccttattctttatttataagcttcaatgtgactattgtgggggaattaaaaatatatataactttttaagtacaaatcatcctcctaaagtgtacccgtgtataagagatgcatgggaatgcatcagtcaattcaggatcaacaacatttcttaggccttgatcttaaagaagtgacttcaacgaattgtaagggcttgatcgattagcaccttggcattccatcaaacaatcgaatggcctgtgtagaatgtaagggtgctaaaataactagtatgaattgaactgaactgaattgaaattaaactgaaacttaattatataaaactcaaactgaactatttggtaggttcggttttataaactgaactatgtagagaacaggtcaattcacaccacgttgaactgttttgaacttttgatattataaaagaattagaaaacgacgttgtagtttatgatgtttattacttggaatcataaaatttgaagtcaggagagacacccattgaatttgcagaaacgtaacagatcattgttctagattgtatggaatatgcaatgctagcatgtacatagtgtctaggttttgcttcaagcctttgaaacaatatttattatttcaatggatgcatgtcagttatttttgacatccagtcttaatgtatttggtctagcttggatgatacctttcagattcaatgctgttgtaacttgtaaggtattttacctgcaattgctcacttattcaaaatttctcttagtttttattatgcaattgaggttatgatagttataaaaattgaaactgaatattagatgctttatttcacagcatataggtttgcattttgttgctgaaaaattggaacaaaataattaaaatgatgggggtgaaagaatgagagcgacaagagaaataggttgtacaaaaacttgaatattgttgatagagaattagagattgcttagaactaatgttgcatttttcaaagctattaaatcaaatatttcagttcaatattttaaattaaaattgttaactaagttgttattaagaactgaactatttttcttcagttcagttattaagaactatttttcaaattcaatttgggagaaaattgaaacaatgaccactcccactagaatgtctcaaaacgcttaactccgatcctttttttgtatgaccatgtaaaacattatggacaatttgattattatttgacattacattagctgtgaatatgtggagtttatatgtattactagtatttttttaaagtttctttatttattttaaacaaaactattatgagtttatttgtttaaatttatttattaaaaaatgcttattttaataaaataaaggattagacaaacacattataaaaaacaaaatttcaaatccaatccggttgtctaggttgggtcggatctaaaggacctaaaccatacatccgggtacccgtgcgtttaccatgtggtacatgttgcctggttagcttacaattccttattacgcaaacgtaggttcaggaggcagaggctctcaaccagcaaatgacggagttatgcttatatagcgcttcatccacgctaattcccaaatctccagccgataggataatgaatctgtgaacggactgggacgagatttcagttattttcctcgatcagtgatattattatgtgagcaaattctatgatcttgtttttttttttttccttcatcgccgagacgaaaatgtccgcatcgcaatctcttggaggtccttcccgctgcggcagagttgtcggtccatcactggacaagataatcaagaacgccgcctggcgtaagcactctcaccttgtctccacctgtaaatccacccttgacaagcttgaatccctctctgagtcctccgaaccgtctccaggcgacacccaatcccctattccaggtctttcctcctcagatgccgactgtgtccttcaacctctctttcttgcgcttgactctgcctaccccaaggttgttgagcctgctcttgaatgtacctttaaattgttctctcttggccttgtctgcggggagatcaatcgccctgataactcgagtgcttcacagtccggcgttgtcttcaatatgattgatgctatctgtaagtcgggtggccttggggaggaggcgattgagctgggcgtgctcagagtcttcctctcagctgtaagatccccctgcattttgatccgggcagattgtctcattcaaattgtgagaacttgttacaatgtgtacctcgggggggtcaacggcactaatcagatctgtgctaaatcggttcttgctcagatcatgaccattgtcttcaccagagtcgaggaagactccatggatgtctttgttaaacgggtttctgttagtgaacttttggaattcaccgataagaatttgaacgagggcaattccatacacttttgccaaaattttatcaacgagataatggaggccagtgagggttttcctctcaaaccatcgtctatatcacctcctctggaagtgcagaatgtccacacaccttcgcccaaagcagcggatgaaacaggtaccgacaagttcgataatgaagctggagctgatggaagtaaaataagggaggatgggtttctactttttaagaatttgtgcaaactgtctatgaaattctcatctcaacagcaccctgacgatcgtatcctcttgagagggaaaattttgtccttggagctccttaaggtagtcatggatactggtggttcaatatggcgcgggaatgagaggcaagtagtataatacttactattcctgtacaaccactatttgtagaatgtaatgtaataattcacgcattatgaacttttattctattcaagggctttttgaagtgagactttcaattttgtagagaaactagtgaatttcaattacttgcatttttcgttgagttttgaactttgaactcctggtttgttttgttgtagatgcttccactcaaacccgtttaaaagtcaaacagttatttatgtgtccaccattcccttctttagttaacaggatcaaggcaaacaatttggtgcaaatttgcagcccttaaactgtaaggtcactatttttttctttgaaacagtgtttctgagcttcttggagaatgtttggtgtgtcctctactttggaacaaatttggtaaattaaaacgagaccttaaagtttggttgaggatgtcatttagatagtcctttggtgtgtttggttgtagtggaatgctcatatctcttaggaaatctctttgcccttgaacttgtaagatgatgggcttatatttatggtttttgtttactcatatctgcttcaagagaactgcaatttcttatgtaaagagaaacagctcagccttgctacagttttttttttttattattttttttttatcttgttgagcggtaaagttgtgccttggtgacttgttggtcatgggttcgaattcggaaacagcccctttgcatatgtaagagtaagtctacatacaatatccctcccctttatcttcgcatagcgaggagcctttgggcaatgaggtaggtagttttgagggcgagccctgacataccggtaaagttgaactttggtgacttgttggtcatgggttcgaatccggaacaacctctttgcatatgcaagggtaagactgcacacaatgttcctcccccttaccttcacatagcgaggagcctctaggtaatggtgtacgtggttttgagggcaagccctgacacaacggtaaagttgtgccttggtaacttgtggtcatgggttcgaatctggaaacaacctctttgcatatgcaagggtaagactgcgtacaatatcgctcccccttacctgcgcatagcgaggagcccttgcgcaatggggtacgcagtttagaaggcgagccctgatacaacggtaaaattgagccttggtgacttattggtcatgggttcgaatccggaaacagcctctttgcatatgtaagggtaaggctgtgtacaatatccctcccccttaccttcacatagcgaggagcctttgggcaatgaggtacgtggttttgagtgcgagccctgacacaacggtaaagttgtgccttggtaacttgttggtcatgagatcaaatcaggaaacagcttttttgcatatgcaagggtaagactgtgtactatatccctccctcttattttcgcatatcgaggagtctctcagcaatggggtatgtaaattatttttttttgtatcaagaactttcttttcagggggtatcttatcctaccctagttatattctcttttttctctcaaataaaattgctttttcaataaaaaaataattatgtactgtttttaggagttaagtagctaatatgcaacatttttttattataaggaggtgacaagtttattaaacatataatgtgataatacacataaatctacctactagcctgcccataactttttttattatttgttggttcaatttaagttgaagaagttttggatgtaacttgtttcagctacttcttttttaaatctctatatgatggcctctttgctacgtgtggtgttttaaagaatatttcttgtatatcatgttcttcatattgcttctttgtttatctgctctttttatttcaagaaataaatagacgatcctttgattttttggtggggttgtatactagttatcggagttagagaattctcaaatttatgacccatcaatgttttcaattgatatccctttttatacataaaaaagatcttttttatttttatttttatgtataaacataagatggatgattgtatatggtcttaaaacaaaggcatttcattaaccacacaatacattaaccactaggttctgctacatggaccaaacaacaccattgtattttctcaaaatcctagcctttagagaggtcatttagatccaagttctttctagttgttttgcttttttttactttgccttcctctacttgctatcctccatctgatcaactcttcttagtaggccttttattggttttcttcgctcatggacaattgtcaaaccatcttttttctctacatatagttgttgatagtgtgatataatcatgctatcatgttgatgcatagcatcatgggagctgataattatggctagcctgtcagtgttttcatggagtgacaattccagataagatcaagcatgctttgttgtcgtatcaaccattagtccatcacactaacgatgggctaaaatcccactttgccgaccctctttcttcattttcctgatgtaatactgtgacaagcaggatgtttcccctggttaagtccagaagcataatattgagccatgacattggttagctttgcactcatatggttgaaataattgtttcaagaattaagttttggagaaataaagcatatgcaatgtgactaatatgtgaagtcaaacaacctttaaatttcctcgaatacagttttacatgaagcaacaaagcacataaagatgggcttccacttcatgcaagattttgtctagttttatggcactactagccttggaaatttgaataaacatgttggaaataggagtatattaggagataagagcctctttattgtttatttttccaagtagcctagatacttggtatagctaggttcattgcatcttagaaagtcgtgctgtagtggtactttaatattctcttgtaaattgttttggcattaattaacttttcttgaatataaataagtccattctgttggccggagaaaatactcaacctcaagcacattcagaaaattttcctttctcattttctcacaaaataagtaatagatgtgtttgttaattctcttgagggtctttggatttgctacattttgtaatagcttggttcatatggtttatatgatctaacttgaggtggagtgtaaaaatagtaggttatagaatatacttctctctttgcgttcaatgacattgacttacacatatgtataaaggttctttccctaagatctttattttccattttattgttaataatttatcatgacacctatattgcttttacacggtgcaggtttctcaatgccatcaagcaatatctttgcttgtcattattgaagaacagtgccctgtcagcgatggccatttttcaacttcagtgttccattttcatgaacttgttatcaaaattcagatcaggcttgaaaaaagaaattggcatgttctttcccatgcttatccttcgagttctcgagaatgttcttcagcctagttttctgcaaaaaatgaccatccttaatttattggacaaaatatctcaagatcctcagattattattgacatttttgtcaactatgattgtgatgtggatgcttcaaacatatttgaaaggtatcttgcttttgtaatattttgttgctcttataccttggtagtggtcagttttcaagaacaaacatgggctaatattttaaaaagcaaaggtgataaataattttgtttgccaaaaaaaaatgatgaataaccttgttaatgcaaaatcattggattcttttttttcatttattgatagaaaaaaaggatgccttctagggtggtggatagtggttgactaactttaagcctagggagtgtcctggaattgtatgaaatgtagatttagatttggcttttgtggcggaggttttgggtgggtgtggttggtgtcaaattaggattgttgaaatactttattaaggatttggaagattaaaattagttctgttagtaataaagtataaaggaggaggattgtgcacttgtgctaggccctcgacaactaacataaaacatggatcactcacataagattttagctaatgctaagtcgttaattggaaatatcgcactgtatgactcgagtacagtgtcaaatgagctatagtcgttgcattgatgtctgaatgtagtgttaaatgagtaagagtcctcacattttcctggatggatgtgtgtgaagaagctagtttagaggtgcttgattaggtttgctacttggaaattgtaagtctatggaggtggatattggataccatgatttggaggaggattaacattatgtacctacaagagatcaagtgggttagagaaaaaagctaaggagctagataccacaggatttaaactaatacatgggaaaagttagaggaataaatggtaggctattattgtaggcaaggatttgaaagatagcgtggtggatttaaaaagaattggggacaaaatcttatccttaaaattagttgtggcataggagatcatcaatatcattagtgcttatacaccacaagtaggattggaggcacttatggaagaaaagtcttgggaagatatggaggggttggtacaaggcgttccataagaggaaaatattttcttaggcaaggatctaagtggatatgaggaaaagattttcttaggcaaggatctaagtggatatgttggtcgtgaggcaagtcaattttcaggagctcatattggtttgggttttggaggactaaatgaggaaggacaaactatttttgatttctttacgacttatgattttagattatgaaaacttgtttcaagaagctagaggaacatctaatcacttataagagtggaggttcaatgtcactgttgaaataagagaaaacaaagggatagttgagtgaaaactgtgtgtttgaatacatagcggaggcttgtttatttaggtttaatacattgattttacataaatagaggacatgttgtttcctctaaatcaaagattatgtgcctataaatcagtattatttatagagtcacaatattatattctgattttcaacactcatgttaaaataggagaaacaaaggaaaattgattgaaaaccatgtgttagagtacacaaccaatgctctattctatagtggtcattacaataaatactaacaatgagaggatattttgtttcctcaaaaccaaattctagtttcctacaaatcctactttcctactaataataaatgtatattatattctgattttcaacactcgccctcaagctaagcttactaagctctcatcatgttacaagaaaataaattattcccaataaatcaataaaatacacaaaattaagctccacctaagaacaatagtttgaaaagcaactcagggatgttgagaagatcgagataattgctagaaaaaaaaatctttgctagataagctggaaggaatgaccatcagtgagaaaattcgtggcaagcaaagcaaggttccttcttcttgaaaccacatttaaaagcttcaaaccaaaaaggttggagaccctaattatttaaactgaaggcgagatagatgcatctggggcaaagtcgttgggacaagtgcatttgggacataggcgggatcagtgcatctgggacataggcaggatcggtgtatctgggacaaagacaagggccaatacatctaggataaagacaaggccagtgcatttgaatataggaaaaaaaggaatgtcgaggaaacactcatggaataaaccgaaaaggattgggtcttgtgcgccttattttagagagcctagtgttgcaaacgacgtccggaaggtggccagatgcgctgaccttagttgctgttaggtgcgcaaagaacgtacgcgtctgtgcatctttggggatgtgtttggtgcaggcaaacagatctggggaaagtgcaccccgaggatgtactggccgacaaaaaacttgtcgaaaaaatggtcaatgaacagtggctgtcgaaaaagtgacggcgaccggaggttagaaagatcgctcgaaaaaggtgcggcaagtagaagggtccaccagggacccattgtccccggtgaggcattgttttcgtgatacccctgttaggctctggataccattttgaaataggagaaaacaaagggacagttgagtgaaaatcgtgtgtttgaatgtttatgtaggtttgattatacataaacagaggttaaccaagtttggttctgaactttgtatagatctattgatggggctttgcagtatgccactattaccagaccagaaattagattggattttctgttaacaaggtttgcccgttcatgtccaagccttctgagcagcactggatggctgtgaaaagaattctgaggtatctaaaagggactgtgtcttggggattaaaatttcaagctggttctcctaggcttcctttctctcttcatgcctattgtgctgcagattgggcatctgatcctgatgacagaaggtcaacttggagcagctatttttacttgaacctaatctcatttcctggtggtctaagaagcaatcagttgtagctagatcgagcactgaggcagaatacaggagcatggctcttattacagcagaggtaacttggattcagtctctgcttctgaactccaagttgctcataccgctcctctcattctctgtgataataccagcactgtctctcttgctcacaaccctgttcttcattctcgaactaaacatttggagcttgatctgttctttgttgggaagaaggtcatcaccaaacagattgatgttattcatgtgcctgcagcagatcaacttgctgatattctgaccaaggccctctctcctgcttcatttgttccattcagatccaagctcatagtagttgaaagaatttcttccaatccctcgtgagcttgcaggggggtataagagtattacatttactcaaatgtatttttttctttatttcagtaagctgttagtctaactaccattgttagtagttagtttgtgattagaggtcattagtgtgtaaccgctagtgacagctgtatcaactaacttaggttagttgactgttaggttgttagttgttagatcatctatataatctgtaactgtaatcagttatgacttgggttgaataacattagatttctcaatctcattctcttctcttctctcatattcactcaactctattaatttggaatgggacgtctaagaagatttggaagcttgcctgaggagtcctgagtgaattaaaaggttttggaccaagataaagaatgttggtggtggaatgaaagttttcaagactaggtaagaaacaaaagagtttgctttaaaaaccttacatgagtgcaataatgcagaaaattgggcaaggtatcaaaatactagaaatgagataagaaaaactgtgagtaaaacatgatctaaagctttaaaaggcttttgtgcaaggtggtgtcttagaggagtaatataaaactattcatttgtctaaaccttaacagcttaagattttggaattgttagtttgtaacaagttctgataaaaaatttagttatttggagtagatcgtcatgttggaggccataccttgggttttaggatcataattgtttccttgcttctttattgattcgttttcttatatggtgtacttggagcactgtctgcttccaaaagttaaagcttattcaaggtctgcagtacaaatctagtgacagattttttatttacttatgtttgtttgattttgcatcttgttttagtatttaaacacttataattctatcagatatttgcaggattgtcaatggtcttctgaaaaccgctttgggaccacctacagggtcgaccactgctttgtctccagcacaggatattactttccgacatgaatctgtgaaatgcttggtcagcattgttaagtcaatgggagcatggatggaccagcagataaggttaggagatttaggcccagcaaagagccctgaaagcagtaatgcagcagagaatcatctaatactaaatgtagaagaaggaaatgcttctgatcacgagctacattctgatgtaaattctgaattttcggatgctgccacgtttgagcaacgtcgggcatataaaatcgaacttcaggtatgtattacttggctccgaggacgacaaattgttatattgtcacaatgttaacggtaaaatatgtttttggtcccactaaaattttgaaagttcggtttaagtccctctaaatttttttgtccgtatttggtgcctctaattttgaaatgcaccacttttggtcctccaagtgctatctacatttcttttcatctctctgtaaagtgtcatctaaaccacttggaggaccaaaagtggtgcatttcaaaattagaaggaccaaaaacagacaaaaaaatttagagggactaaaaccaaactcttaaaattttagaggaaccaaaatcataatttaccctaatgttaaactatcctcttatactagcataacattgagttctaattgtttgattttacctacccaaaaacctatattgtgtttgtacaattctcttctgtatctctccttctgctcccatgaattgcatttatacataattttgtcttcctgagctgcaaattttcatattctatgctgatgcttttttttttttttttttttttttttctgggttaaatgcagaaagccatatcactttttaatcgaaaacctccaaaaggtattgaatttttgataagcaacaaaaaaattggttgttctccagaacaagtggcactgttcctgaagaacactgctggccttgatgaaaccaagattggtgactatttgggagaaagggaggagttttctctaaaagttatgcatgcttatgtagattcctttaacttcaaagggatggattttggtgaagctattcgattttttcttcagggcttcaggttgcctggtgaggcacaaaaaattgatcgcatcatggagaagtttgctgagcgctactgtaaatgcaaccctagttcttttagcagtgcagatactgcctacgttcttgcttactctgtgataatgcttaatacagatgctcataataatatggtgaaagataaggtttgaccttgctgaatcttttatattatgtcttaggctcaacagttagagtaccagctttgtgacattacttgatgtccaatctaggtgtggtttcgtttctattaggcttaattgatttttttaatagttggtacatcatattttactgatgaaatttgaatatgataattttaatcatagaaaattatcctataaaggcaatttgatttatgcgtatttattctgaatacagctttgaaaatatcaattattttctctttccatttcttttatcttcttatgtaggtggtggtagttatggtaaatcatagctttgtgtcagggaaacacagtgaacaccatgagctataacatcaacatgtaatatcattttgtaaatgatttggatatcatttgattgcttatatttgttctattgttttacaaaattgagattgtaagttcagaatatcttacaatgctgaatataggtttgacctgaatttgtggtgtatattctatgttaatggatttccagatgacaaaggctgattttgttcgaaacaaccgtggaatagatgatggaaaggatttaccagaggaatatctcggggcactttatgaccaaattgttaaaaatgaaattaaaatgaacgctgattcttctgcacctcagaataaacaagctaatagcttcaatagattgctgagattagaaggtatactcaatcttgtgaactggaagcagaatgaggaaaaagcagtgggtgcaaatgggcttctcattcagcacattcaggagcaatttaaaactaattcgcgaaaatcagagtaagccaagacatttctcaatgtttggatttttattttaggcttaaatataatttgggtatcttaaatttaggcctaatttccttttggttacccaaatttaaaagtgtttttttttcattcccctaatttggaaatagcccacttttggtccttatcacggagactaaaatgattgcaaaaaataaccttaagggccaaaagagggctattttcaaagtagggaacaaaaataatcatttttaatttgggaaaccaaaaggacaagaaatttggctcaaatttgaggaaccaaaaaaatatttaagcattatttttttatcattaattttttttggaaatgtatttggttgcaaaactagacctgctaagctctttcttttccacaattttttgtatataggctttgatttggctggctctgctacttgatatctttcaatggattttttttatctaacatttttgagaggattcagaaggtttagttaaaggaattttgaaatgagtaaagattttcctaggagggtgagccctaacacaacagtaaagttgtaccttagtgacttgttggtcatggattcgaatccggaaatagcctctttgcagatgcaagggtaaggctgcgtacaatatccctcccccttaccttcgcatagcgaggagctctgggcaatggggtacgtagttttttgttttttttttttaagattttcctaggagatgatctagttggtcacatgaatgattgtctagagtatagtagagggtaaaacatttctagattttgctttagctaacacttgttttaggtaatgggaagaacatcatatcacatactaaagtaaggtgacatgcttccaaaattgtttttttttccctctaattaggaaatcagatagaaacttttgcatggattgcaaagtcatacttggagaatacttgtttatccagcataggatcttggttatggatatataactcaagaggagagtaaatagaaatggttaagataggatttcaaggataaaatggtagcaattgaagggaaaaaaggagttttgaaagaagtgagggagggtttttggaggacatcggtcaaattatataccatgaggtatgaaaagggtgtaggagcataaaatggctcattgagttgtttaacaagattatgagattggagataatactaaatgagtagagaagtgccttattctctatattttttttttttttttgatcggcaaagataaagtataatattaatattagggcaaaagatacaagtataaaaacaaaaacaagtccatgctagcaaaaaccatagctatggtagcctaatacatagaaggcctgaattagaatatcatagcgaggatggacaaagccccccatacaagtatgataataaccttccctatacacgaaacatatccctagtattagatgaccatacatgaaacggcaagtaaaagcctttatccaaatttttacaccaccaccagcaaaagaagagggcatcatcaaacagcctatggctatcaaaccccccgctttggaaaataatactatttctgtgaccccaaatagcccctatatatgagtatgagaacaagagtgacttctaaaactggtctagttatagaaatattaagctcatgagccatattatgaaactacaagatagggtaattaagcagtcattatagaaaatgaattttgttttatgtcggggaggttacccacgaaagcaaatatacttccttcaaagattaatggaaaaacattggaggaattaatggagagacattagaggaattaaaaggacaattcatcaatttggaaaaaccatatggtggggtacgaagagaggtattgtccttcgcttaggaaatgaaaggagtttgtcctgcttgtagtcgggcaaccaaagatatgtaagatggtttcaaattagagtgtgaacataaggtgaggcgcacaaaggactttcttataactattggactgcaccaagagtgagcgtcaaacctctatctttttaacttggtcttggatgttcttatttcttactgaacatatccatgaggcagatggcataatgcatgcattttgcagatgatatgccctggttggatagttgagagaagaaataaatgagaagcaatagaggaggagacaaactttggaagcttgacttttgtttaagtagaagggaaatgaagtatataaaatgttagtttagctagaggcgcactaattctagtatggacatgaaatttggagactataacataccacaagtcataggttctatagttcaagtttcttggtcatcatacaaatgatggggaaatgtaaaccatagaattcaagtgggatggatgaaatcaaggagtgctttaggtgttatttgtgataggaaagtaccactcaagcttaagggaaaatcttactacataactataagacttgtgatgttgggcaatgaaatccaacaaggagaaaagctcaatattgtagagatgagaatgttacgatgacatacagacaagtttgtgaatgaatgcattctagagaacattggggtagcacctattgttgaaaataaaatatggtagattcttgctttaggtggtttgagcatttgtagagaagacctatataagtcccaatagttagaggtagagaaaaactaagaaaagtcttagggaaaaccgttaagaaagatttagatttaaatagtttgtatattgatatgatatatgagaggattttaccttttgattcatgagagctggccccacccggtgggaaaaggctacaactattgttgtttattgtttatatatttatgattgtgtactggctctgcatcttagatcctttccatatgtgcattttccttttcctttaaggattagctatctgctggattatagattacataagggatgttaatctttcaatgcgtttcatagtttagagtttagacattttatttaccggttattgcagatctgcgtatcatgttgtcacagatgtggctatactgaggtttatggtggaagtttgttgggggcctatgctggctgcattcagtgtaacacttgatcagagtgatgacagggtagctacttctcaatgcttacaaggatttcgacatgctgtgcatgttactgcagtgatgggtctgcagactcaaagggatgcttttgttacatctgttgccaaatttacttatctgcactgtgctggagatatgaaacagaaaaatgttgatgctgtcaaggtaagtgaatcttaatttggatgccattgacattactcaaatcaaatcactcacctttattctccttttgcatttataatgataactgcttattgcacaccatatattaatgtcattttagccatattgtacttatatcaagaaagcagtgatgaatgggttcactttgattttatttgcttaatccttcgcatgaaaatagaatgtgattggtacatttttttgtgtttatcatgtgaatgaaccacttgatttcatgtatatgtcattttagtatcttttaaatcttatttttgtgcaggcaataatatcaattgcgattgaagatggagatcatctgtatgaagcatgggaacacatattaacttgcctctcccgaattgagcatttgcaactgttaggtgagggtgccccaagtgatgcaaccttcttcacttcagctaattttgaaatggaggagaaagcactgaaaacattaagtttctcttcttttaagaaaggaacactccagaatccagccatggtggctgttgtccgtggtagttcatatgacagtacaagtattggggtcaatgcttccgcaatattaacaacagaacagataaataatttcatttcaaacttgaatctactggaccagattggaaactttgaactgaaccatgtgtttgctcatagtcaacggttgaatggagaagcaatagtagcatttgttaaagcactttgtaaagtttccatttcagagttacagtctccaacagacccccgtgtatttggcctcactaaaatagtagaaattgcgtaagtttctttgtcctttttatgatagatgttttctttgtgcaattcattcagatttcttaaataataattttcttgacatatggagcttgcacaatgaatataaaccatgcaatttacactcagacattgcccattttgttttatattccttatttgtacttttcctagtgtgttttggtatgaatatgaaatatcctagtatatgaaattatgaatacatgaccccagcaattttttctcttcctcatattgaatatggtgttgacattgtcatatgttttaggcatttagcccaatgttgtggccaagcacgaaataaagtaatgccttgccctgctacataaaacctattgcttttgatatttatcttaagaaagtggctgttatagatggaaaaagtaagaattttaagataagttcaactattgataagctcaactattatcataactcataaggaattatatggatgtaacttggatgccaagtaacctggcagattgaaggtttaggtttttggtatgttcaatctcctcggtcccgtgtttgagtgttgtgatcttcttatgctgttatattttaaatcacaaaatggtcattcaaaagaaaggaatttcttgtgactatgagctacttggcaggcaaagctcttaaggactagcaaggtagggtgttttaggactttggcagatacatatggaacaagcttggcacatatgatatatagacaccggctggaggggagtgttagaatatcttggatatttatgagatatgttaagatatcatgtatgttggaaagccaccttagttggggtcacccctagcccaccttagttgtggtggttggtagccatgggcaaagaggggtgtgttgaagttccatactggctagagatagtgttgagatatagtatataagtagggagcaatcctcaccttacaagccggttttgtagggttgagttaggcccataatccactttctaagaatgtatctattatagaactggtaaggaatcaatttagataaaatcatcttttaattttgaaaaacatatactacatcttgagaatggttttatacatccaacatttcccaagaatcatttgaggttaaagcacaaaaaatgcacaagccaatttttccttttgctgaaattcaactttatttataaatgggagcttacaaggattgaactcctaactgattggtcctggaagctctaatatcatgtcaaggaacaactgtccaaaaagcttaaaatgttacatggtggatcaagaatggttttatgtctctaactctaacatatttatgttaattgttatatcttttagaatgagggaaatgttacttgcctgaaaggggatcctttgttgattttattagaccttaagaaagggattgtgattttctcttggtcatgttctttgtagctagtaattggtgattccaagttattctcttctcatgcacatttatgattaaaattctaatgatcattcaatctacttaagactagaacatggttgcatttgcaggcattataatatgaaccgcatcagattagtatggtctcgcatatggaatgttctctcagatttctttgtgtcggttggattgtcagaaaacttgtcagttgcaatctttgcaatggactcgctgcgacaacttgcaatgaaatttttggagcgtgaggagctggctaattataacttccagaatgaatttctgagaccatttgtgattgttatgcagaaaagcaacaccacagaaattagagaattaatagttcgttgtatttcacagatggtccttagccgtgtcagtaatgtgaaatctggctggaaaagtgtttttatggtaatgttgaagttggcttgatccccccccccccccctccatccctccctccctccttgagaccatttgataaacaacaaaaattgaaactgtcaaatgttgcccaattgtttttattgaagaaagcaaaacaaattgagaaggcacatttgtgattgtttactattcttttcaagaaaaaattacattttattacttgcatacacacatttgttggcaatttagatagtctaaacaatctttcaggaatgaatattcatggtcaaattttaatacctctaaaacggcttgttaaaaaggaaataaatacaaataaaaagaaaagaaaagggacatcaaggatacatatctagtcaaactattgatggttttcaacaatctaaatgcaatacacaagtttagtgtaccagcaaattgttaatataatgacatttaccaccatgttcagctatgggcttcattaatgtccccgcttccttcctaagcaagaagaaaatgcacatctcatttgttagcatttgtgaattgagacaatggaacaatcttgacttataatgcagtgtttttgactcaggtttttacagctgctgcagctgatgagcggaagaatattgtattactagcatttgagaccatggagaaaatagtgcgtgaattttttccttatattactgagacagagacaatgaccttcaccgattgtgtccgatgccttttgacatttaccaatagccgattcaacagtgacgttagcctcaatgcaattgcgtttcttcgtttctgtgcattcagacttgctgatggaggacttgtttgcaataagaagagcagtgttgatggcccatcaattgttgtagcaaatggtatttcagatttacaatctcatactgataacggtgatcatgtctccttttggaatcctttgctatcaggtaatatgcatttagatgatatgccctaagatatttggtacagtggccaacgtaccataacggtggaccaaaaaacttattcttgtgaatcttgtccaataaatgtatgtattctgtttaattgattgattgcataaatctcaaatgtctattgctcacattcctgttgaagctgccttttatatacagtatgttaagctttgtattaagtttttgcgttaaattcttgagcaatgattgttgcattttgtcaacagatttgcttgcacttctcttgttagatgtagcaaataagtggtacctttagctcctagttagtgtcaaaaaagcaaacgtaatagtgatttaaccacattttgtgcagcagtgagataacataaattccataactcttgtctgttctttctgctttaagttaatatttttatattttcattgcagggttatcaaaactaacttctgatccaagatcagctatcagaaagagttctttggaggtgctttttaacattttgaaggatcatggtcatctattctcccacacattttggaatagcattttctgttctgttattttccctgtatataactcggtatctggaaatagagagatgaatctacaaaaggcccattgttccccttcttcagtatctgtgcatactgaaggaagcacatgggattctgagacttattcagtagcagcagaatgtttaatagatttatttgtcaccttctttgatgtggtgaggtctcagctacctggcttggtgtcagtactgacagggttcattagaagtcctgttcagggtccagctagtactggagttgctggattagtgcgtctcacaggtgaccttggtaacaggctttcagcagaagaatggaaagagatttttctatgtttgaaagatgcagctatgtcaacagtgccaggattcatgaaggtcttgagaaccatgaataatattgaggtgcctcacatttcacattcttctgctgacttagaaagttcttctgatcatgacttgaacaatgatgaatttgatgatgacaatctgcaaacggccacatatgttgtgtcaagaacgaagaaccatattgctatgcagctacttattgtacaggtttatttcttgctcgttttgtatgtgcataagttaacaattaaaacataagcactaaatttcctagtattcaatttatatgcatccactgaatttaaatcgtaatccactgattttgttttattagttttttcatgaaaacagatttaaagacatgtgtagtgcagcttgatataaatttcacctctgaatgagttcatcttgatgatatctttctgtgttctattggcaggttacaactgatctgtacaaaaagcaccagcaatccttatctgcagccagcatcaaagtccttattgaattatattcatctattgctttacatgctcgtgagatgaacagagagtcaattctactgaggaagttgcagaaagcttgctctgtcctggaaatatctggccctcccatggttcattttgaaaatgagtccttccagaatcacctcaactttctacaaaatatacatcttcatgataattttgtgcatgatgagatagagctagaacaagagttagttgctgtgtgtgaaaccgtattggacatatacctaaattgtgctggttccatttccacttttcacaagtctgataccatgccagcgcctcatggaaaactccctctgagctcagcaaagaaggaagagatagctgctaggacatctttagtcatctcagcattgcaaggattggctggtctgaaaaaggattcattcaggaggtatattccacggttctttcacttactggtagatctcgtgaggagtgaacacacctctggagaagttcaacatgccctgagtaatatgttccgttcatctgttggccaaattataatggactgagttttagttttggcatactttgtttttggacgttgctgaatatcaatcagcattttccttataagctaaagaacgagccattacatggtcatatcttgatttactcaccattgttgtgtagtgttactcttggttttttgtgattgtatgtgccattaatgtaaatgataaatttatttcaagcagaatatggaagtaccacagatagatagcgaagagacttaggcagccgctggcagtctacaacttggcctgacttgttccttttcaacaatggagattgagtcatagtggaaggagatagtttctcttaaggaaccaaaaaagtagtcttgttccttttcagatgatgtttaaggttgtgacataagaattaagatatataattaatattctttttttaagattgttacatgatttcttattatattatttatttatcttattgattaattttctacaatttattttttattgatctgtttaattccatgataaatgggtaagataattttaaaatatagataaatataaggatataattaataaaagagtaaggaaagttttgaacttttaaaatgagataaaaatgaacaaaaaaaaaattcttaataaaattgacacttgaaaaagggtagtatttgtcaaaaaggataatatttaagtaatttaaaattcttttaaattaaatagagtctattcgaatatattattgttattattgttatttgcttaactgttaccttcaggcaatgattaaaaactcaatttttttatatatatatatttttatttagaagtgtatctcttggtaccaaaaggcttccaagtttgttatcctaaggaaacttacctttctttttcttgtgtattgggcgaatggttttgagtataaacatgtatatttggtcgttttaatgatttaaaaattcctgaactaatatattgttggtaatgactgttgtatttatgtgcattatggtgatttaaaatgtttttttttttttttttttacgttggtgatttaaaatgttttaggggtaaaaatcactaaaaattcttacataatgaattttatttgcgttaatactttgatgactcttatactaatcgcgagtgattgagtttataacttttaaaattttaataaaaaattgtggcaattttagtgaatatcatttttaaattagttattttaaaatttaaaatcctacccatgttagtatcttaatgatcaaaatggattcattcataaacataaaggaggaaagcgtgatcgatcaaaattcttcattcaactagtcacattcttatttcattttacaattataatttgtgtaatttttttatagtcacaggtattaaattcttttttcgatttcaaagtattaaaaaaaatcaattattataataataagtaatatcaaatatttaaaattatgtgaataaagaataaaaaatagtaaaatacataactatcaagcaaccgtaagtataaataaaaaactttaaatacaattgtgtttcccatttttaaaaatattttgactccgttgatacaattttaaagaggagggaatctagcatttaaattccattatcacttatcaatatttgaatgatatggttttttatataaaaaaataaaattggttaaatatctttatgttttgttttgagaggagagcaataagtttatggtgagagagaaaaatatcggcatttcctcattctgcagtttggttggagttgtataatctctttgttgtccggcgcggacttcttactgtcactcgacctcgacctcgacctcgacgacggtcagttgttttcttttccatatctcgtggctttgctttcgtttcgtagtagtgtatatcctgaatcctgatcgcagaaatagtattagtaattgggatataaataaattaattagtgatggataacgaggtggaggtgctagaatttgatattgggctgggaggaggcgagggagaatatgacgatgacgacggaggaggaattgatgaggaggaattggctgtagccactggaggtggggaaatatatcttcctgagggggacctcttagatcttgaaccttgcgagggcatggaattcgagtctgaagaggctgccaaggccttctacaattcctatgcccgtcgtgttgggtttagtactcgcgtcagctcatcccgtcgttccaggcgcgatggagctattatacagaggcaatttgtttgcgcaaaggagggtttccgcaacttgaatgagaaacgcacaaaggatagagagatcaagcgcccacgtacaattacccgagtcggttgtaaagcctctctttctgtcaaaatgcaagactctggcaagtggatcgtctctggctttgttagagaacataatcacgaactcgttccaccagaccaggtgcattgccttcgctctcacaggcaaatttcaggatctgccaagacgcttatcgatactttacaggctgctgggatgggccctcgtagaattatgtctgcacttattaaagagtatggtgggattagcaaagtcggcttcacagaggtggactgtaggaattacatgaggaataataggctgagaagtttagaaggtgacattcaacttgttcttgattatttgagacagatgcatgccgaaaaccctaatttcttctatgctgtgcaaggagatgaggatcagtccatgaccaatgttttctgggctgatcccaaggctaggatgaattatacattttttggtgatactgtaacctttgacaccacataccgatctaataggtatcggttaccatttgctccctttactggtgtaaaccatcatgggcaacctgttctctttggttgtgctttcctaattaacgaatctgaagcatcatttgtgtggcttttcaagacatggcttatggccatgtctggacatccgccagtgtcaataacaactgatcatgattctgtaattcggtcagccataatacaagtcttccccgagacccgccaccgtttctgcaagtggcacatctttaaaaaatgccaggagaagttatctcatattttcctccaatatccaaattttgaagcagaatttcacaaatgtgttaacttgactgagtcgactgaggaatttgagtcttgctggtcaacacttgtagataaatatgatctcagggaccatgaatggcttcaagcaatatattcttcttgtaggcagtgggtacctgtatatttgcgagacacattctttgcagaaatgtccatcactcagcgaagtgatagcatgaactcttactttgatgggtatataaatgcttcaaccaatttaagtcagttctttaagctctatgagaaagcacttgaaagtcgcaatgagaaagaagtgagagcggattatgacacaatgaatactttgccggtattgagaaccccatctccaatggagaagcaagcatctgaactttacacgagaaaaattttcatgaggttccaggaggagttagttgggacacttacattaatggcatccaaagctgatgatgatggggaggtcattacatatcatgtagctaaatttggagaggaccataaagggtattgtgttaaattcaatgttctggagatgaaagcgacttgcagttgccaaatgtttgagttttcaggccttctttgtaggcacgttttggcagtctttagagttaccaatgtgcttactctcccatctcattatatactgaaacgttggacaagaaatgccaaaagcaatgtaatattagaagaacatgcttgtgatatatatacttactatttggaatctcatacagttagatataacaccctccggcatgaggcttttaaatttgttgatgaaggcgcgcggtctgttgaaacttatgatgttgcaatggatgctttacaagaagctgcaaaaagagtttctcagggaatgcaaaatgagggaaaaattcctatcagtaatggaaaggtaaggagtcatgtgctgaacgaggaaattcatgctaattacacaagtgggtgccaggaagaaagcttgagccagcatatgtctaaggtctgatttccatttgaaaaatgtttttaatctcttttatgatatctgtttgagtgcatttactctttcatccaccgttatatgaaaccaatcccgaaccttcacctaatagcttaaggcattatgatataaaccttgacggcttcacctaaaaccaatcttgaaatcgtaccagagctgctatgaccaagtagttaggagtttgatccctgccactttcattcttataaataaagtttaattctgtcacaagatagagaaaacctgtgcaatggccttgtctcaagccctaaggaattggtgtgagggggttagagatatataactagtcttgaaccttcatctaaccgcataagattttgagaaagttgattgttggcacaccctttttagctctcaaggtaaggctagttactttttactcttaatccttcaataacctttagttattatgagtgcttttgtagatttactgtatttaagtccagatacatacatacatatatatatatatatatatatatatatatatataatcatttgtggtattttaaataaagctctgtttccattccttgattcaaatatgaattacaggtcaaagtaataatgaagactgtacactaatttaggagtctaaattggaaacagctaaacctaacaatgaaataatctgaacagattagaatcaggagggattttatatacaaatattaatgatgttgaaagatatatagaaacttcgttactgtttcattttcttaaatttagggggatttattattcttcccctagatgtactttctcttatttctttcaaatattatattctttctgaagaaagaaaacatttattgtgtaacagattttatatcattggttttaaatatataatcattcatgcttaagtatgcttttgtttattttagtttcattgctttatgtcctgcaggatgatttggataagaatattagaaaacttatgaatgagcttgagtgtgcaaatcggaagtgtgaaatttatcgctccaacctgctttcagttttgaaagctgttgaggatcacaagttagagttgtcagttaaggtggaaaacatcaagataagcatgaaagatggcatctaaagactatggagaattaaaattgaaacagataggaaaacaaattctattttggcaatccagtcgcgcatcaataatgatcccatgacaacccgccgccccacaattgtcttgtagacctcttattatgtataaagttggtttgcagtgtattatttttttgttcagtactgtatttattatattgatgtcaacttttatagtccaagtttgctttaagaaaataataatgtagcacttatacgtcatcgtattaatatttttctgagtttaataattgcttacatagttttttcttttttaaggaattgcttacataatttttaacccgcagaaaatgaactatttgatttgcataaagtccaagtgtttcaacaactatttacaattttttaataccatatgaagaaaatattaaatgaaaaataaacatatttaatgttttagaaattaaaatgcatttaatacttttttttccctagtaagaagattaatagaaagattttgcaagagaatttagaatattcttttccattaatcatcatagattgggtgtatttagtcaataaaaattgataagaatgaatttataactcataaagacatagattcaattttttttgtccatgtaagaattttgttgataaataatatgtaagtatctctatcaacgttgactgaatcttgaggtttagtctgcttttgactttgatgaatttctgatattcaaattacaaaaatcaagtttaaattcaaatttataatcacatagccaattagatggtggtttccatgtttagtgagtgtcctaagagaaattgagaaattgcctcaaatattcatttaccaaaatcaataacattgtaggctcaatattctacaatgtaccttttcttttatactattgtggtatggtatcatggttgtaatttcttataaaaactctactcatatcttgagagtatttttaattgtcattcttcaatgaggatgtgtttacctgcttttcttactatattttttttttgttaaaaaaactatcaataattactatcacaatataaattattaatcataaatctaaaatatattttaaatgtttcaaaatatttatttattataaattttaattataatataaattatataattaaaagtatttatttattataaattttaattatatccaaaaagcatttattttttgtaatacacatgataaaatactagtgaggtgtaactttaaccgagagggtatttggtaaaggatatttttttatacccaaaatcataattcctaaaatcaagaatcctaagataataattcaattattttatatgatttaaattttttacccaatgtagatcaattgatgaggttgttaaatttaaaaagttttactctgatcttttttaatgtcttgcttagaccaaattgatccttgtgatagtttttggtactaatgatgttaaatttgattgatgtcatattttttatttttgtcatgtgtgataaactaacatatgaacctctattgtataatagagaaactttaaaggattaatgtgatttttttaaaacctgaagcaccgagattctatttaaaaaagaaaaaaagaaaaacaaatgttgtcataaagttttcataatttttatttttatttcttatgtaaattttttgaattttagtattacttgttcagtctaaatcatttacatgtgtaaaaaaattatacagatactaacatttatttcctcatcaggaatagacacacgtgcttttttaaaaatataagtacaaaaaacattaaatttttatatggagtaaaatcaaattttgacctagggataaaaatatattttatctatttcaaaaatagtttttttacaactctattaaaatatttcttgaaatgttgcaacaataatattctgaaatgatttgttaattaatgtcctaactatttttaaataattaaaaaaataaaaaagttttttagaagtataatatttaatgtattaaaaaattaagacaatgtattaataaaaaaacattttaaaaattataatacgtatactaagtacatttattagtatttttattcttaaatttaattatttatcacataagaaaatattttaaaaaattatttattagattcctacataccttatgagaacaattttatgataaacatgaataaaaaaatattcctaagaaacaatgataaaaaaggatatgcgcttttttaagttgtctctcatcagatgacaaattattatatataataatttttttacttcgataataatcaccctaaaaatcacaccaaaatttatttttaattgattgatcatataaaatcttacactgaccgtgtatattcatcaaactcaaacgatatttcctgtaaatgttttttgtaatatatgtcaaacaatgagaaattaatatttctaacttcgtatgcctggacaacttgttgcacttcctaattccaactattttttcttctattactacactactcggaaaagatacacttgaatgaaatgctactagatttcggttgaaaagtcacagaattttattttttttatattgaaaattgcaaagtcatagtggtggtactataatattgcagtaccaaattgatccctgcaaattaaatatcggacaatacatatggctatatcaaattacaagggttctctcttgggggaactacatttactttcatcgaacataactatacacaagaactccaccgaacctttttttacgtacaaccacggaaccaacgacgtgacaagatttaacttggcgtgttaaaggcagatattatagtgccaagaaagagtcttcagcctcctaacggtgattaagtcagtgtggaatattagctgagggactgtctggtggccaaagcactgtacttaacaaaaataaataattacgtaaaggcataacatacatacaaacatggaagagaattaagtaatatcctttttaaccccaaaatgattgaaatgaagaatgattcctattcctattcctattccgtcctttaagtttcatccctggccatcctagattttccttttagatccactcattttagtatatctgattttttattattaaggaatttgcatctctgcattccacatctgaattcgtgattttccagtctgcatgccacattttaggactattctgtctgtcgtacatttgcttaacattcaatgtcaatgccatgaagcaaagttcagcaaatgcaatgaaatttacccttcaacctcccaagatattcaaaattcaaatcacaaattccaaatgcactcctaatcatcaaacctatgaggaaaattgatagaataggcctagagagtccaaaataggtgacttaaatattaaatgattcaaatattatctttttaatattattcagttttattttaaattctctaaaattagatgaggatacttgtgcggttgttattgacaaccattttaggttataaattttatccctcatttggctgagtatcaatgaagaaatatttgagtctttattttattagctctgtaactttctatagttttaatggtagattgataggagtagagtagtagctcttttgagcctataaaaaatctagttgaatcttcctgtcttgtggcaactgacatcttggtaagcatctaactattctacatattccactgacacttcatgtttaaacaaaaccctgatataaataacaaggtgtatatgtccatgcgtattagcatattatctttcctgtactgttttaattcaatcctttcaaaataagaaataaatatgaattaaaatacaaattgtatatttgaaaaaagatttgtgctcctggaagacaaaacaatttattaaaaagggatacaaataagtcattggaaaaaaaggaataaaacctgcatgttagactgatactctctgggtctataatgccaactggatatgttctttcatagatattcctcacaacaggaacatgattgaatctgcgctccttcataatcatttgagcataacgaagttccatatcaggtgtagctgtccatggcacgctgcatatttctccatttaaaaggcaaaattcagaaactaaaagctcctgtaagaagaagaaccaaataatcagatttgtgaagcaacaacaaagtagtttagttcagcagttgataccaaatatctacaaatgaaacacaattaatagaaaaggggggagggggggcttacaatatcttcaaccaattcatctacaaggcactttttaaactcggacttgtgcatcccaggttacattacaaatatagagaacctacatttgtgtaatgactgctggttttcaaacaatgattggttaaatgtgttgtatcaccgattatgtattatgataagtgtctgccaactccaattcatggtataaaattgcaagctcataattaagatacaatttcaatagcatacccatcacctattatcttaggatttatagattcacatccaattaatactaaacttggattcttgtaccttatgttttgtgcttcttgcttttgcaaatttaccatactcttgaatgtctctaagcgtcaaaaaaccgattaaagtatcatcggtatcaacaattacggcacaagattgtttctctgcaagcatgagatctattacttctataagtggtgtgcacattgaaaccgtcacatatcttgtcttcatggcttccgaaacaaatgttctccttacaaaatatgttgtttcaacattatcatcctctacacaaagtgaactttccacttgacacaaattactcaaatatgacacatcttcagcaaaggtattaccagcagatgactcaattgaactacgagaagatatttctgaaagtaaagcagaatttgagttttctaactccattttttttgcccctctgtcatctcctctttttgtctgtacagatgaaatccatgacgacaagcctacagctccaagaagtggtagaacaatccgatagtcctgtgtcaattcaaacagaagcaaaactgcagtaagtggtacttgacaaactcctgcaagagtcgctgccatcccaacctgcaaaaggaacttcaatatggtcatctatgcactaagcgtagttcacaaatttatgcattatcaacatgagacatttgtaggcagtgaataaattcttcagtatctgaaaggaatcccaagaaggctgctctggtctgttaaaggagagagagactcactatggagttatacactaatgcaaggtccattatagatagaaggtccacttcaagatattgtatgttcttgggtggaaacttggctacatggagaagcaagaagcaaagcgtaattgcaaggtcaagctcatttttgggctatagcagttctcatcccttcaattatccaaaagcatatcttcattgtctcataaaaggaatcattttcttacactatacagtgcttcagaatttcaaattgctagttattgctttcattttgttttagagtttgagcttaggacaataggacctaactaaacgccacaaaaccaacttgtaaggagaagactgcccaagacttataaggactacattgattatatctttagtcgatgtgggatctcatcacacctcgtcaagcctaggactagacatttggagcatagataatgcaggtggcccaataataccacctcctcatgcctaggaatagacatctagatcatacacagatacaagaagcccagtaacagatctaggatagactctgatattatcttaagaattttggctcaagacttctaatcaaccccacaaaaccagcttctacagggaggattgtccaaagcttttaaggaatatattgggcatatctctagtcaatgtgagatctcaacaacgttaataggtgacagttctgaaaccaacaaactgaaaacatatcattatataccatgactattgataattggaaatgcaatggataatgctatttgtaagcatgaattgaagcttatgtaaattcattccagctacttgaacacaaaataagttttatgatttcaccaaagagtaaatgctttgttcggaaatttagaggctgtatggtttgttttctattacaccatttcctcacaaaatcttgaaaataggaaaccaaatgaaaagaagctagcgtctttgaaattgttagtgaaaacatatcaagtgaaaataaaacagagcataaaccaaacacccttgaaatgtataaaaaaaaaaaaaaaaaaaaaaaaaagcaacgaaaattagcaaaagaaaaaaaaaagattcaaaaattactttcctttcacttgattggatgtttacaaagtaacattattgaaacacaagcaatggacctatcctccactctcaaggaatcgaaaaattgttagaggtagactacttatcttttatttactgaaaaaactcccaagcaagagaaatacctttcatttctcttccttctttcattttactttcagcaaaaagtaatatgtattataataataaggtaagtacaagtggtactattatatttacactgttgccctactatgtgtagacctatggagccctaatacaagctgtattgcaagaattaggcatccatagatctggatttgtctagataccccttcacaaaagtaacctatagagcaatccccccctgaatacaaaacccgacccttatattcctagcccaagaatgaaaaggagccatatccagcaagaaaaaagggcatcatccatcagcttaatacattgataacctaaaatgccaacttatgcatttgacatttattgtacccatggcatccttcttttaatcagatatttaacaaaagaattttacttacagagaatagattacaggacagatgtccaagagattctcctaagataacatgcaagaactgaagagacaggactttaacatcaaactagttagcaaaccttatggtccctatctagaatcaaaattctgaaatattaaaaactcatattaggtacacacaggaaagagagttcctcttggaaatggctctttgtagacccatggtagtcatcttggaaagatataattgatcccccatgtcaaagagaagaaaaactgacgatgccaatcataaaatacgaaatggtaaaaaccatataatagccaaaatggaaagaatagtaccaggccataagcttgtggtgatgccacttccaacacagagaggttaatcgtgggattagactcagcaacagccaaactaattaattttccataagccatcccagttgcaccaccaataaagagagacggggcataataccctcccactaatccagaagccctgcacagagaagttgcaactatcttgacagctattagctgaagcaataggtcagtggaaaggcctttaacaaatggccgagattctaataaaatgtcaatattctcaaaaccccagtagaggatttcaggatatatcaatgctatcaacccaactgataagcctcccaatacagggaatgaagatcgtggaatgccagtggccttgtgcagattgtcaacaatagtcaacatatatgatgtacatctagatagggccaatgacaccagaccacataaaatacccagcaatagatacagcgggagctctgaaatcaagttgaatactctcactttaaaacttacccatcagattgagaatagcaaaatatgttcagaaagaattcagcttttgttttcttgaatttcaaaatcagcagttcaatacaatatattacccaccagtttctgtttcatagagactaaaaaacaatagagaatatacaatatcaaacctgaaattctgtaagcagtattttacaaatgaaatcatattaaactacaacagaagttttttttttttttcatttgaagtttaaaatcttgcaaaagtatgataatgccattaatttattgctctacttctgaagttctgatggtcaaaccaggagattcatgaggagtgatgctgtgcacctgtgactcttgtagatttagaagcagtcaaagattttgaatgccagcagtacagacaattcgcaaatcaattagaacaaaaacagcagcagttgccgcagcaatgttggtaataaaggaaagttttcagcagtcaaaaaggagtaattgtgaaaaagcattagtattggcttgcctagcagaagaattgtcaataatgatgaccatagtgacaagatgagcatagtcagagaccacgttgatgatgaaccgttatgtattgaagcagaaagatataagtaaaatggccatactatggaatttatgcccaagtagttcaatgatccaatatgacaccctaaaggtataatttacttgcatttggctgcttaaatcttcattgtaggagaaaagggactagcttactagaggcttccatgtattattatacttgactagatttaaccaagtttgtaaggaaatgtccaggtacagccattctgagttgtatttttgcaagataggcacagtcagttagtcaagtgcgttgttaaaccaattcagtacacatattaacacatacataaatggaaacacttcatgtattgatatactttgctgaaatttgacagggaagaaaggaacaaagcaatgaacaagagcaagagaatgaagcggtcaagtcataaataatctcaaagaaaaatgtgttgatgacttaccaccaggggaccggaagtcatactcgggaactttaaaggcaggttgagagccaaggccaatctcagaaactacagaagctatgacagcactaagtatcaccatggaagtattatttgtaagtggtaaagatgcatctgcagatgatggccacaagacagactcgacagcgaaaaaacaaccagcgaccgcagcattgaaacctgataagaaatataaattagagaagaaaataatcggatcccaggaaagtgataaaagtaacgtgtaagtgtagataccggcagagaggccagcagcagatccagcagcgagaagggagagcattctgccggaactatttccattgtcaaagaaaggacggaggcctttggcgatggaagtaccaatatcgacactgggaccctctggacccaaggaattgccggtgcctagagtaacagaagctgccatggcctttaagaaagggcgggaagcagacttgaggttggcagatggagtttggaggaaaggatcttcttggacagcggaatcaaaacgttgacgaaggaggtttagcagagacacaataacgcctccaaaagtcggaactagtactacacgtgcccatgttgtctgaataggcgcttctctcagccatgaggcgcctcgattgggaatcccatcccagaacaaatcacgaatttcatgaaccttattacatgtcatgaagttacatataagtatattatgataatagagagtatttatctatctatgtatagcataataataacaacttacagcataattgaagagcacgacagcgacgccggtgaggagaccgaccaagcatgaagatattattccggaatcgccaatccttctggtgaggagcttccattctaactctagtagttgtacttcttcctcttcctcttcctcttcctttccagccccagcttctttattatcaggcacacaacacggacgcctcgccctaattcgacacagatgagtctcgtgtgcagaagcagaaggaaacaacgaccacgaccacgaccaccaccttgttagtgttagttcttcagatttagaagcaaggattcgaactcgatcatggtgccagctggggtgaactcctactcctgctatgcatcctaagccaaccatttctcacgatattccaacttcttcccacgccacactaactcatttttccccctctaattgaaaataacttttaaaagctggaacggataaacaatagatgaattttttttgaagaatgcttacttattaaataataataatttcttaattttttcaaaatccaaattttacacttaactttttttttatcatattattcattatatctattacttgttttttctctattacttctctcttttttcacaaacaaacaaaaaattattcgatctaaccaaattaaaattgaacttatgcatatataaataattgttttttatatttataatatcactcatttacatattttttccttctatatttataatattatcacataacttgtttatgagatatatatttaattaaagataatttttgtaactaattaagtaaatttattgataagttatctagttgtgtaaatttatttttgtacatatttaaagagttatactactattaattatatattgacttataaacaagatattataatttttaatgttttttatgtttaatatgtattttattatttatttaaggcttaattaccaatttgttcactaagttatttaaatgattaagtttggtttttaaacttgcaactgctctaatcagattctctaatttttaaaaatacttagaatcgagtcatttccatcaaattaaaactaataccattaagatgagatttctagaggtttgatttaccaataaaagacgtcactatctttaattttattttaaaaataaaatatttttcccttttctgaaatcaaatctgaaacctacaaatttggaattgaatttgaaactcacaatacacaagcacaatcacaattattgtattcggaggttagagaattcgttggcggtggcatgacgagggagtctatgatggtgagatgtgtcatcgatggaattgatgcggagggaacaaccaaaggaggtggtgttgcacaatccgtcctgcacaacatacatgtgtgcgtagtttccaacgaacaacattgatgtacgcagaaagaataagcgagacagacgtgacgatagagaatgtggcgagggcattgaaggaccaccgcaccatcctcccttcagatttgaacaaaaacgcgacacttttccttcagatctgtacaaaacctcaacagtcccttcagatctaaacaaaaaccgcaccaccctccctttacatctgaacaaaaaacacatcacactctcttcgtatctgaacaaaaaatgtgcaaccttcccttggccactgtataactacaacaacccatgttgttaccatggatgaggactacgtgaacgacaatggtgttgaacgtctaacaacattagtttaattggccagaaagaatctaattgatgcatttttaaaataattttgaaattaaattaataattatttaatatgttatttaatacaatctcatccacaaatactcctaagtataacattaagagtattaacaacacattctttctaactttctaagataaataattattaattaatttttattaaaattataaaatcataaaaaatgctcattaaataacaaatgactcttaaaaaaaattatttccaaaaatttagtaaataattgagcgtgtattcaaaagaatatatcaaaaaggatattactaacatttctggtatcttaaaaaaaaaacacttctcgtataatatttctgacgcggcaaagtactcacttcataaaaagcattgtcctcggccatcactttgaaatcagttcacatgcacaagaacctcccaaatttgctaaggttcgatcaacaaagtcacatcgctcaaactataggttttccccacttttttagaactcacaaaatttaggatggggcgagggaaggctattgaattgctaggtcagggcaacgtccttaactccaacaagagcttctagtggaatttacatctcacgcatcaagaagaataatgtagacaatcgaacgtaagcctggttctatccatgttgaatgttgagatacacacactattacagtgaactaatatgtattcgtttgctcaaggctaaacaacaatgaataaaaaaaatccagtataggaaaaacagaagacagaagtgatagttatctttgtatcttcccagcagagtgcagataaattgcaacagagacaacactgtaaacataatttaacaaacttttattcaagagaaaataaaatgggtataaagcaatttacgtgagactacaaaatgaagcattaaaagctattgccccgaggcatgcacatcaaaatgaagcatttcaaaatttaacacaagttatcattaagagccaaagccataaaagtactaaaaaaatcaacattttaatttcagttgctggtatagtatgatgtattcatgtatgtgcaatacttgggtcatggaaaagaaaaacacaacataggacacggcaagcacaatcatgatataataagcagcaacttacactgtgcccaggaagaaggcgagggagagatggaagccaaaaaggaacacagaaacaactgctgtaagaagcatcgcaactgaagtagaatacacctgtgtcaattggaaagttaatcataaatttgaattccacttcaaaggttttttgcttgagctagtaaggctgtaagggtgccataacgtttgaataaaccaagaaaaacagaagcacacatatagatcacatttgatgaaagcattcatcaatcatcataatgcagctctacttctaaatactaggcacagaataaaacttgtgtgcagttcattaagcgagctcagattctacaatcaatatatgataatgtgttcagagattgtaaatcacattctatatactcaaacacaggatttcctcatgcaattcagaaatcgtttctcccttttcaagtatgatgataagaaaagaaataaaataatatcggacagagtaaagtgatgatagaaattttaatatatttttcatttaactgtagaacctgagagcaaacatctaatgagcatcacttaagttttgtccgtaaagaatagtgggggtctacagcaaagtaacaatatcacacactctagccaacaagagatacccgcaagggcacataactctaaccccacaattttttgcataatttcatatttatattcagtatgtgtgaccatgagacatacaacaaaaagtgtatcatatgaacaaaccaataataaaaagttattgtagatgtagcatgtttaatcatatgaataattccaattataaaaaaaaaaacccataatcttaatttaaactcatgaaagtttcaaattctattaatacaactaaatggtagaaatatcataacacagtcataaacccaagtcttactttcacaatgttgtcagcatatttcattaccattgatacagcaattccactgcaaaaagaaacaaccacgtaaacacattacatcaacaagaaagtcaaaactgtaaaacaataaaataatgaaaacttctactagtatttgcttgaaaagagatattcacattttttgtgtagtgaaagagatagaaacagacacatagaaagagagaggacttgatgagttaaaggaaaatagcttaaaaatgacaacagttgaatatggaaatcaccaaagataaagttgaaataaagcctgtttcatgcaattggcacatgaaccttcccgagatttgcttattcacagtttcatcaaccatcaaaagttgtttcatctttttgtcgctcatactccacagtccacatctcaagtaacctttcatttcaggaagaaacagaagaagcatccaaacaaaggaggggaaatggttgattaatagaacaccaaaaacagaagccagtgcacgactcttatccatttcaaaagaactgagcctaagctcatacaaggatgcaaccagagaatggactgctgggagaaagctattttctgtcaacaaaaaaaaaaaaaaaaaaaatttacgccagcatgccttgcagccactccttgtattcccactctactcccaactgatatgtcaaatcagcataacaaattcccctccctgtcttgaatttggactaaagcctaagaattgtccaagcctgtataagctctacttttgccatatctatagtcgatgtgggatctcaatagactggatcccaacaactagtggtggagggagggggtgacccacaagggccatggtcacccccaagcttttaaagtgtatttatattgttaaacaaaaatctttgtccctcctagctatctaccataaaaggaaaaaaaattatctatcctgttagttgttctatttcttctcagacacgctaccctactctacctccacttggttttcttctttgagaatttggattttcctcagttcctcccgttcttcttcactcttgatcaaatcttgattcctctttatttcccataatttaatcatttgttagaatcatattgagtttcttttcattgaagtgaataacatccaaaatgaacaccatacttctatccttttaagttttaaggaaagattacaagaagacaagtaaaacccaaaatgaataaaatcaagaaacatattgtgaacccacatacaaattgtatcagttggtttaaaaactttaacaaagtagagaaagagggaaacaacggtaaatttaaatggtcgcgtatacctcttgtactcaacccaattatgtatttcttttactctaaaaagtattagttatacatataaatttcctgcatatgttatgtatgtggaatttatttatttagtttttactaagttatgttttgggtcttggccccccttaaattaaatttttggctattcccctgccaacaactagatacacaagaatagtaattagggaaaaacttccatccctcaataaattttataaagctcgtcatttacctgagtgcatggttgaaaatcatgagaactgtaatgaatgaatatccatggaagaatcccctgaataaagacataaggcatatattactgacgtgacaatttaggctttataactacaatggaaatatgattgtttataatacttggtactgacttatatgatcaaacaacatatattatgtgttattgttatgaaccttatcgtaggatcaagtcacaagcctagacatagaagacttctgtcgacctatagtgaaagaaagaagcagactcgtccttgactgagcccctcctaaactaacacaagtttttctgaatatttctccttgattaaatttcaatcaagtttgccatttaaataggctacaaaaatatccctaacaattatcctaattgatcataaatgataaaataaaaataaagagaatcctaactaataattatcccaaagaatataataaagatctgatctgaaatcaagattctgatatcaaacttattaagatgggaaaagataaaataaataattcaagatttacatacaataatcctaatttgaggccttatcagttatcccatttgatgaaaagatttacttcatatatgaacacaagaaaatagcgagcaaagatcaaaacaaactgcaaagtcaaaatctgaaagaagagatcgaattacttgttcatcaccgcatcaaaatcttgaaccaacattgcaacagcattgaaacacatgccaaagacatataaccagaagttctgaacatttatgttccgtgaaggacgcttttttataatagcctgccaaaaattatgtaagaaatctactaagccacaattgatagctaacacatcttactcgatgctatagtaatagagctcataaaccttattttaagcagactggcacatctccaatgattaatcaaatttagctcaagcattaataaattcagatagactggataaataatttcaacttaatacaaaaagcgtttgaatctaaaacaatttttaagcagaatattccatcagtcaatagtagtcaacagaacagagaataattttggctgtagattggagtggagtgccatttcatgaaacctcaagggaattaatgaaactaaaattacctcagtatatactcctgcaaaaccactcaagagagccatgacctaaaaacaaaaagttcatcatgatcagtttcaagccaaaaattcagcttatattactttatactcctaatgtgaaagcaccacaaacgttaacaactcacaattgccatcacccaaccttgaaagggagtttgaagaacatgatcagaactgaaaacacaatacaaatttttccagataaatattaaaaaaaaaaaaaaaaaaattatcaataaaatgtaaaacttctgcaataccttttgtgtgtagatcgcaggtatattcctactatttatgtatgatacaagcaaggagaagttactgtaatacacacatttttcagcagtcacacttgctaaattactaacctatcatttatggttcatttgtttgttacatctatacataaaaatttcattaacatgtttattactagagaaaatctatacaacagtcatgggaacatacaaatacacaagtgatggccacatgtcagccttaaattattcttacttcgaattcaactgggctgtagtgcacccagcagcgagtagaacaaaagcagcccactgaatctcacttaacctgaaatgtaacaagaacacaatgccaaacagcgaacaatgaattttggttatgtaatgagtccaactaaataacatttctcagtcattaagcttaaaatgattaaatatccaaaataaagaataataacaattaattatgttcatagaacatttcataacacaatgagttataaaacaagtgaaagtacgatggaaggagcttttccttctcgtttttgtccacataaaagtttggcatacagaggacccgacttgcattgatcctccactacagttctcatggcgaaaggagaattgataattttttttttttttttgcatttgaagaagagagaacaaaagacttaccttttcttaagtataattctgtataggacacccgtactgataatattaaagttctttaatatttgatagcctggagcatctacatatgcaaagatgtaatactgccgtaaattgaaaagtaaatacaatcagattcagaaagcattaacatatctgttgcaataacaaagttgtagaacaatcccattgccaccataacaaacaaccatccatcaccaacctgaagcaaatttttgacaaggtaaagtgctgctggaataggatacactataacttcatccaaggttgtagtcaacctatgtccaaggaacaatacacatcaagttatcaagttatttaaactcattctatatataacaccaacaaggggttctagctcaattggttaagcaatgtgcgtgaattgttgcgaacccagattaaaagaaaaacaccaacaagggggaaaaaataaagcttcaataaaaaagatgaagttgcaaatacataaacaccaccgggaaaattaagtgaacccattggcctactcaacactattaacaatataggttctagccttatgaactcctctccacctaaagaacactgttcagacactccccccaacacacataaaataaacaccatataaaggaatgtttgtctgtttttcaaaattaaaatatcaaaaaatagtggttttgtagtcatggggaatacagttcaaaatcacattaagacagtttttggttttaagagttaccttgtaagaccatataaccaaatgttttgattaccaagtgcaactgtgattacttgtatatgatgaagtattaaattttcaatcagattcacaaagtaaacaactaatttcttcctatgaattagccatatacaggttatttcttcagggaataaggaagcccaagagtttacaaatgcaattaacagtcaaattagtccagttctaaaaatgtcaaaaagatcggattaaaaatgttcacaaccataaataaagataaaatgcactgttaaaatgttaatatattccctgacttgcagctcttcattattgcggacatagtagtatttaagaaatctaaacaaaacaaaaaatggcatcacctgttgtcctcattgacaccgtcttttttccatattcttcccaaggccaccagggatatagcacattttaaagtctccacctataacaaaaagagtaataaagcaggtttaggtttgaagttatgaaagataataaaagtagaaataacagaatgagcgtataggatatgacgatgtgatataacctcaccataaagttagcagtagtgacactatactcatacttgccagctctcttggaccaaacgattagaatggcttgcgaactagtaagaacagtcaatgcaagtgtaacaactgacctataccaacaggcaacagggataataattaagaaatcaacaagtaagtatttcacttattatatgtgaattgttgtcatacttgcgcttccactttactttctccctgtggctgtcaattttggtttctccctcggaagtcaaatcgttatctgggactggaagagacacgaaacggatgttacattaaaacaacacaactatccattattcagcctggaggagcgatagcgataccactacctgacagcaaaaatgattttccaacgtcctcaacgtccgcatccctaacttcatcctacaacaacaatgcatcaaaatcgtactattaattgaagaaatatgcgaaaaaacactcacctcgtctttgattttcctgtattccattatatcacagagatctacgctttgtgcattggataaacagagttcaaactctaaactcttactttccttgatgcaccggcaacagatctcggcgctcaccaattatgatattataaggccacgctctctttctgatctctctttgctatgcataaacaaaagtttactatcacattaaattagacttaattatatttttttataaaaaaattatctttaataaattaatttgacgtattttattaaattttttattataaattttatttttaattttttatatttttattaattttatccttaacttttaagcttaataatggaaaaatggtcgggataatatatacaatatattataaaaaaattagaggtaaaaataacaattaagtctttaaattatttgtgtaattagatgagttttgaaaaaattgattttaaatggaagtgattttgtaaaattaattttaaaattatgtttatggttgtatattattattataaaattaagtgaggagtaaaatttagtataaatctttttatccaatacaaaagttatttaaaattgttttaattcataattaattttgaacttttttcaatgaaatcaaatatgtcaaaatttatccaaaattaaatctactcaatcaattatacaaaataaaaccaaacatacactaatgactttggtatcataaaattacacaatttttacctttttttttctttaaacatttacaataactctcttacaacacataatgatgtaatgtataaaggaatatcaatgtatattttttaaacaattaaaagatcactgcaagggtaaaaaaaagtaaggaaaatttatgtaattttataaaagtataaaaatatttgtataatttactcttattttagtaattgttgatcattttagttttccatgtttttataccactattcatctattttattttataacacttcactttattcatttaataattcattgtctaatttatttaatgtttacaaactaactttttttatcacaactagagttatgttgtttgaccacgttaaaaaatacttcataatagcattttttttaatccattaaaaaatcacattaatctatcttgttaaccattaacgtgtaaaaatggtcccgtttcatttctttcttcctagttcctactatgagctatttgtgcctttgaaaaattcattttccttcacatttcttctcaatctggtgattatcattcaaatacttttttaaatagacaacaattaactcctcttattattattatttttttgcaaatttcttcttctatttatattattgtgtgtatatatgctttggcttcatttttgtagattctatttgtgccttaggcttcatttcttcttctatttatgcttttgcaaattttctcttatttttttttatattgttgtgtgtatatatgttttggcttcatttgctttttatattgttgtatgtatatatgttttgacttcattcgcatgtatatactccatttatccttattcttatatgcagatcgaagtcgttcacttctctgtcgaaagagcgtattcttttattatagctaattacaaatctcaattagtcttgtttgtacaccaatcccaatgactaattcgactcttaagcctggaacacaatcaaaaagaaattctcttttgtctctccctcgaccaatttttacattagtgggcggacaccgccccaatcctaaaacaggaacgaatctttcaattgcagttgaccacaagataaagaaagcgattgaagcaagcattagtagtatcccccttccttcgttgtaggtccccctcccttaattatttatttagaatatccctttggctatcaactcaaagagtaaagcggtggtaagatatggatttttttgtgctaatcatattttttcttaatatatagattatttatccatgtttctcgcatgtattttttccctctaaaatcttcaaccatatttgatatttagttaggacatttcttttagtacacatgcctccttgcgtttttgtggtaaaattgttaaaagcttgctaatggcttatttttctttcttggagacatttactgattaattagtcttttctttttttgttcttttatcttttataaaaaaaaataacaagggtaaaatggaaaaatataatctttatacatagcaaaaaacacttaatattgtttgtgccataatagattatatacatcatacacttcaacacatatttcatgcatctatcttaattttgcacgtactagatttttctaacttttgcttgttttccacaatatttgtactatcatttaaaatcacaaacattcaatattacataaaagggttttaatatcggttatagaggaatttcaatatcaattttagaaccaatatttaaactgtcattgaaagtagacatttttaatgtcaaatttaaaatcgacgttgaaaatcattatctacatcggttagctgaaatcaatgtaaaaatgttgccaaaattatgtattttgaagtgttttctacatcgattctgaaaaaatcaatgttgaaaatcgtatacaacatcaattttttgcaaaatcgatgttgaatgtgttaaaccacatcgattttggccaaaatcgatgttgaatgtgcctttataacatcggttttcgatcaaaaccaatgtggtatagcacattcaacattggttttagaccaaccaatgtgatatacttaaatggttagcattgtgcacaataggagtgcccttgcactccttgcacttacatttttgttctcctaacaacagagttttacattgattgaaaaatatatgataaaaataaataacataataaaaaagtatcttaaaagaaaaaagtaaaaaaaaaaaaaataagtaaaataacgttgcacaagagataataaagcattaaagttgttatagaaagctaagtaaatataaattacaacacaaatctattgaattagtattgtcattgcttccatatgttaataacaataaacatcaagtttgtagaacctcaatatagaaaaattgttctcaatttagagacaagacaacaacttccaaaaaccacttaatgagggaaaggaagatgaagaaagagcaaatataagacgaatagcctacaaaaaaaagtgaatgctgatgaacaatgttaagcctaaaataacgttgattcagtggcaatgtcgtgtttggttagagtaggttgcactacatatgaacaggatgtacaacaagtaaattgtcaatgacatacacaggcaaaacatctgataatcctccattactaaactagagattcacaacttgtgtaacaggaaaattacaaggcaataatcagagacttcttccttgatagattatgtcaatgggaataacctaaaaataaataccaaaatttgagccactagtgtcactgagagaaagctaaacctttacgttttcacattgaataacctgagaataaataccaaattttgaattagaaataatttttttttatcaagaacaaagatgtgattaataaggcaatggtataaggatgatagagttactaatatatctgagctttacatattaacattcatagttttaggtaatattactaaaatataaggcaagtgcatatttttatccaacttctttcacaaatatttgcagcatgctagaaaataaaagaaaaatactatatagcaattagcaaagagaaaatttggatgaccttttcacaccttaaataaaacattgaccttgttaaaacaataaacgcgtgattcatcaacatttaaagagttataataaatgctttaatgaaaattgtgtggaaattaagaaacaactattttgcttttgatacgtacctacatggatttaattgtaggcatccatttgccatggcaatttaacgagctttgaattaatccattagtggtcctcaaaccttgtattagaaactggtaacttttactgatccactatcaagttgatactactaccttggaaaatacagaaacgcatctatcagcaactaggcatagtagccctttggttttagatgagacttgcacatgcatattatattacaaatgcatgacttaactcaatagcaaattgtttcaaggaacaacttcctaatctttacacaccatggtaaattgtagttgacttggtaaaattcaacttcagtgtaactctaatttttgttatcttacacattcagggacgaaaatggttatttatccataaatttatttataattatactatcacattttttttatcttatattgcttaagttcaccatcatattgtaatgtctaagttggtttcttatatgctttgacaaattataatgatttttttttcctgcatataaattttgtttatccatttctttttcctcgctaatcatggttttttgtacatatttatgcataatattataatctttcatgagttaagtcatgaacaaatcattgttatattaattttatagtacatagcatgatttgatgccatattttgccagttaagttttcaactatatagtttttacttatttttaaaaaaaaatatttatgaatggcgtccaacaaacttgttatttagaaaatatacttaatctcgttcaaatggtgtataaagtcaacttcattggagagattaatggcacgagagacttggaagttggcaataagaataaatagtatttggcatgtgcagaaatctcataaatcagcaatgatgaaaatgaatatcatggatgtgaagatggatatgaatatcatggatgtgaaggtagtcttatattgcttaagttcaaaatcaaatggaagataattgtttattgaatttaatttgttcatgacgtaggaagataaaatacaagttgcggtgaaaaaatatgatgttgaaaagtggtagtcaatactcaaggagggtaatacctatattttcttgaattttgaattcattgtaacaacaaacaatataggatttctagggatccattaaagttggtgttcacgaggagattaggggaacaatcttaaaagaaatataatcttagaatcttagaaaacaacaaattattttcaacgttttctgtacaaacctttgaaaacaaattaaaaccaaattaacagttttataaataaagggtgaaaataaaaaataaaaacagaaaacaaagctgcaagtaagcgccccctaaaattcagagattcaaagaatatattttataaatagttggtgaataaaaagacaaatgtgaatatcatgataggaatattaggatgaattttgtttttattaggtccaaatgtttttttttttttatgtttaagaccttagcatttagaagcaacattattagaccttgattaatttaacttttttcttggtacacaaaattaaagtagaatacttataaacatatatttattttctctttattttatttcaaattatttttaaattttattttcttattatatcactcatcacatctatcattttttatctctattttttcttttatactctaatccactaaaaaatgagataaacttttatatttttttactttgaatcaagtcaaataaactcacttaattaaggaggtaaaattctctgagagttcatattcttaatgaagaatatatgacttaaaaaatttagaaaatgtttttgcaatatataaaagcaaaaagtagaaagtatttgaatggagcattattacaacaaaaaacacgtgagagaagagccgacaattacattggcaaccaatgaagcatttggatctactattgaatttggcacaaaaacacctcaccaaagcgtcttggattcaatgagagagcagacaagtccagtttaaatagcaacacatcaccgaaccgaaggcaatgggtggagagagagaaatggcgaatggtgactgacccagcagaaggaataaaacaggctgtggtagagctgtaaacgttccatttcaccactcttatgatatgatatattttctccgaaaacatagctttgagcaaacagcagagcataatgtttgggtgtacaaaggcatcatcgctgccagtgtcgtcgcgttcagaggaaggaggccttcgaagacgtctttcttcgctgtctctgaagatccaagacagcccaacatggtcatttcccagatccaagtccctctcatccatgggtgactatgcaaggacatggtgggactggagctgggcctggatcctctccaggaagctcatctttgccacagatctcgaaattaacgaccaggaaacaaagctccttggctcccacaacaggggcacttggaggcatgttttctataagcttcgctctgagatcagaaggttcatctctacttctgatcacgccactcttcccaaaacctaccacagttccacccctcaactcttctcataattccctccacatttctcaatgcttccttcaaataatttactctttatttcagatccaccgtggaaagcattacgtaagccaattttatgtacaattcattcttcatgttaatttgtttcctgtactcagttaattacgtgcatattctattaattgtggattgttataattaaatttgttgcctaatggaaacaattgaacatcttatttatagggtgattgttgcatactgtattatcttatagttgtattctatggtgaatgtagaacctgccatttttctgtttcagaatcccctgccctgcccaagtaattcataaataatgattgctgaattctgaacttgttgccgtgagattgaagtttcctctcccacgtcctcctattttctcctttttcattacacatcgtctgatgccgttttacgtcgcggttataatataattaagctaacttccttccacggttccaccaccatgttaccgaacaccattattattgctttgtgtcggtgcacaatttcttcttttattttctgttttttctttctaaataacaaatatagctaaatcctacatgcaatgcttcgtttgacagttggcggtaaggaagaaaatcatgtagagaagataaatcggtgagaaacaagtaacgtaaaaacaaatatgtaagaaaatgagtgcatttttatattgtttttgtaggtatggtaaaaaaaatagaaagaaatgcttaatttttttttatatatatttgattagaaagtgtaaagaaagaaaataacgtttttgtttaacacattatttaaaaaaacataagattaaatgacaaaagtatcaaatttagtaaaaatgtacacaataatttttttatcgagaataatttttatcaatttatatgttgaatttaaagttttcataaagtataaataaatcgatactattattagattaaatatcaacaaatattcactttaatttttcttttatattatgagcttatacaaaattatcattaatataattatttaaaataattattataaaaatcaataaaatttatcatattcattttttactttggacctcaatgtccccacacatgattgttcatgatcttcttaaatagtcaccgacatggatctctccagttagaaaaaactggaaagtgccgaatttacaaatctcatcaccatttatacatattttttttaatattttatattttaaaattttcaaatattaaaataagctaatggttaagatttcatgtagttacaacaatttagttcatggatcatgaatggtcccaataaataatttttatttaataataaaagtatgagtaaatagtatataaaattagaatataaaaagtttcactttatcatctaatcatataataatatattaaatttattaattttgatgataattattttaaaaattatatcaataataatttaaaattgattgaaaatgtaagtttaggtgaatgggacatagatattaaactaaaaagtattgtgtgacctaaattaatgatggcaacccgtggaacatttgaaccagctgtcgtgtttctcaattctgtgaaaattgcaggttggtcctttgtaaaatatagggtggggaagaaattttgtgatttgggggttttgttgcttcatttgcaaaagcaacatgatatgatgtgagcatgcatatcaaagctacaaatccttatagaaggacaacttgtggagctcaactgcatcgaatagtggcagctgatgggtcgtggtagtccatgtgtgacaacccactttgtggcttgtgctacaattttaatgtctttttttttttttttttatcatggaggtgagaaagagaagggtaggaacagggcgacacaatcagcaccggcggatctacgtaattgagagtgggcagatgcatcccctcatttcaataaattactagtatttgtcttaaaatattatattttacatcccataattttatattttgcactctctaattttatgtatttgaatctccttacaagtttacatgtaagagtaagtaaatatatcatcttattttaataaaatgaaaaaaatatcatattttgcaccccataattttatattttgaaccccttaattttatgtatttgaacctccttaccagttcacatgtaaaattaagtaaatgcatcctcttattttaataaaatacaaatatttatcttaaaactttatattttgttcctcttatcttcgtgtttgaatttaactatcccatataataatgataattatcaatttttattttttaaataaattgtccccactaatcagggtcctagatccgccactaacaaccgggaaggagaattcttattgggacgatttgttattggcttactgccacgatgagagaccattattttggtccacttccctgtggatcaatttgttgcaaattcgggttcacatcgaagattgtggtacattaggatgcatgcaggattagaaggtgatagagatcgagggatagtttgttgaaataggtgagtaatagtttgttgaaatagctgtgttagtaatattgtcgaattcaccattctacttaaatttgggaggtttcataaactgactaataaaatcgattcgtaaactcataatagtttactcaatataaaaatatatattaatattcttatatataaaatcataattaaatattttaattctaaaataaatcaaaataacaaattttaacaataattcaataaactaatataattcacacccaatcaaacataaattcatatcatacaaaacataaaacataagttcttcaaataaaagcatttaaaaaacataagtaattcaaatgttcatcaatcttctaattaagtcattttcaatatcaccatcaccatcatcatcttcatctccatcatctttaagttcttcctcgattgagaagtaatcttcaacattgtcattcaaaatcaaattgtcaatatcaaatgcatctaaagttgaatcacttaaacttcttcctccaaccacatcaatattacttccactacgactttcacctagaggttgctcaacttgaacattgtcttcatcaaaaatatatatccctcttatgttatccactcatcatcacattccatatcttcaaatggaagaacaacatttttttcttatttgtctacttttcagattcaagttatacatcacataaactaagtcattcatattcttttaatgcaagcggtttctcctctttgtatgaacctataaataatataaaaaattgaagttcataacttaattaaagtataaagtctaaactaaacaaaaacaaatattaaaaaacacaaaattgtaaaatcgtacgattctaccgagtttggtctaattctaccaagtctggtccgattctagcgagtttactccgagtctaccagaaaacgattctatgtgcgattcaactcgttaggagtgtgtagactcacaaaatgtatgattttaccatttaaaactagagtttgataaccaagttttagtattggtagtcaatagaaacaaataatgataattgttcatttcaatattgatctagttttatttaattaattaatttattgatattaagaaaaataattaatttaattgataataataaatatttttttattttttttcaattctatcattatcattaatattttttttctctatttaaaattgtgccttaaaaacaagctatttttaaataaaaataattaatataataaacattataaattaaatcttaaaataaaaagaatataatatcacttataatttgaaccttataaatagaactaaacgaaacatggcctcttctaatcctagacataaacaacatataaccaaatcatcaaaataaaataaaataaaaaagtgattatattagttatctttaattaatactaacatacattcaaattgtattccaaaaatatccgtaaatgatgattagatatatttacactactcataatccaacatatttttttcaaccagtaagaataagttatattattaatatctcattaaatacatccatttcattgaaaatgagtgatatcttactaatagacctcatttattaaggatgtaaaagaaaattagccactaataatttaaaattgattatatatttcttataattaataaaaaaaaataaccatttgtttctttagccgaaggtaatatttgatcaatagttcaaacagttaacatcaaattaaattaaataactgctatttttttatttattgaagaatgtttggaccaactttttctaacacattgtttgatactaaattcatttctttttccacattaattagttcatgagaaagcgaaagagactaaaaataagtagttcatgagaaaaataagcagtacaacttattttaaaaaaactaattcacttgacattttttaaaagctaattcccccctttttcttttataaaaaaaaaaaactgcttaattttttaaagaattttactctattttaaaagcttttattttgaactttctttaaagtaagctttagctataaaaaaagctagaataatacgtatttgtttagggaaagaaaagccagctgggaaataatatgcttcagcaatgtcactttaacacaatgcatcatactccacaaaggcttcttagtacgcccaatacatcatatcatgcgtgtgaaactttacatccgtgaaatcaagtacttgaaagatcaaaatccttctactaaactatagacagaatgcccctacatgaaagcacagaaaaatagaagaccaactcgaagtagctgtaacacccaacactaaggtttacaaagcgagaaacaatttttccactcatacagcacataaatgtaacatttgatgaatcctcatgcgtgagcacccacaatcctgattgttcttccgagataggaccggtcagcaagtatgaacaattttttgtaaagatttttactttatttttctctttttggctttgctgcatacaacctgccaaaattgcattccagaatacaggaagagtgacgttaacaatgagagtaataaaaagtcaacagatattcagctaatactcgttttggcaaactgcaggatataaactatcatgcaagacacaccttgttggaattactgcttaaatctagattcaactctaaatgcattattcaagatgcagaaccaagatctatgattggaacgatatatatttacaaagatgtgcttaacgggagtcccacccccaccctaagtttggtctcggggttacatctttttatataactactactactactactactgtatataaaattgcaaaaggttcatcagccagttggctcacgcacacctccaaatgtatgcagatatgctgccttcttcagtttatacttccataactcaagctaacctaaaacctcaaaatgatttttttttcatcaggaaatcatacaccaacatattacaaagaatatgctatagacaaggcagctccatagaggaccaccaatatcctgtgggttgatagtacgactctaacatgtattccaaactgtcattaccctcttctggggagcaagaatccaatgaataactcaacttattcagtagatttgatgggccatcattagaagaataaaatcaagtctagaagtatctgctaaagaacaagcagacacaacaaaatctgggacacttcaacttcaattcaacagccatctgcacaggatgctttacaataactgatgctaaaatgtgagcagatcccaataaaatattgggtacatacgcaaatgggacctatataaattgggaaataaggcttgaaatgtcatgaagtgataactgaacttcaatcaaatcatttcgggttcttaggttcatgatgacttcttgtgtacaattatttggaactttaacttccaagagtgagaaactaacatctattgcctatatgtctattccaaccactagagatggcctaccacataatattagaagtatgttggtgattacaagacataccatttgtgatgccttttgacctctacatcttaaaaattcataagaatataaattataaagtgggcaaatagtatttcttacaggggataaaagttctattttacccaaagccaaaagtacctgtacataatgagcacaatcgtaagctattgagcacttggtgcatctctcatgcttaaattcagactgttgcgcatagtcctcctaccaattccagcgttgcctttttgcatcatggcagcaaattcaccataatcaatccttccatcctaaaacaaaagatataaacataatcatgaagcataactgcacaagaagatggtccaggaactaaattcaattcattattgataggcgacaaagaatcatgcttgacaaattattagaattcaggcatttgatatttaaagtgtatttaaggcatgatatagttttgattaattaattgtttttcacaatctgtgatcagaaaacgtttaatggatagatcaaacataggtcctaacttcctaatgcataattcttgtagctttgaaacgaaactccagttaatgcaggataaatgcaaattaatatagcttaaaacatgtaagcattctttaaccaaagaacattctatatttcaagctaaaaaccatttaagttattgaagtacatattacagaaaaattgaagactaaaagagcagtcttttaatgaggatatatattactatactgtaagatcttctaacagcctacaaggatttcctatgtgaatgtttagcacaggttaaacaacttacattatcttgatcaacttctctaataatatcttcaagaaaagcatcagtcatgttatgttctgcacaagcttgttgaagttcatcaactgtaatgtagccactaccatccttgtcaaaatattggaatgctgcaataagatgttcttcacgctctagtttgttgagatgaacagttgcagcaataaactccccataatctatggttccacttttgtccacatcagcctgaaacaactcaaaacattttagctgtgaatgaaacatgttcaaagattatttaacacgaatacaggatgtggctcaaaagaaaaatggagtaatgcctgtaaaagatgactgaatagtccctggttttcactaatgtgatgcctaatgtcaacccccggctttcgcatataaggaaatttaaaatattatatttaaaaataataactaaataaaataggaagtataaacacgaaatacaaaaaagaaacttttcgcagaaccaacaacctaccgcttccataagatcacgtatttctatatccttaagggtagacccatatcttcttagaccagctttgagttcatcgaaagtgattgcaccactgttatcagtatccatagcctgaaacatttctctcaaaccagcaatctcctcttcggatagactttcagcaatcacctaaaaaattagtataataagcaattataactacggttacatagtttcagacaagcaaaaggataatagatgaaggagaagtgaaaacaaagggcaagtgtggaagcccaataaagtgaggttcatttggcatccaagaagtgcttgactccacaaagacaacaatagcactttacatatcatgtatggaatccattatctttttcataacaacgtatgagctacattcatacatactatatttattcatcaattagcttcacttagagaacgagccctgacataacggtaaagttagatcttgatgatttgttggtcatgagttcgaattcagaaacaagctctttgcatatgtaagggtaaggctgcatataatattacaatatccctcccccttacctttacatagcgaggagtctctgggcaatgggatacaatgtttttttttttttttttttttttttttaattagcttcacttactcgcagagccatcttctttagcttattcattgcagaaaactgtttgagacgagaaagaacagcaggatccagtgatctgtcaggggcaactccattctcacatatccaaggatgacctaaacaggcaaatgacacaagtaacattgtcagacaacacattgaaacacaatattttgaatatttacaaagtttaatccttaaggaagttaagctggaacttgcttttgaggaaacatcaacatccagctaactattaatttagataggactatttcttcctgggtgagtctgctatagatgtggcaacgaccacaacgccagtgagactttaatcacctattacatctttaataatgaagataactttgaatgtatgagtagcacaggaaaagccaatttctaatgctcagtccctcaattacatctataataacatccactgagtaaccataacgacttagctactagtgcaaaagggcaaaacaactatgcttttgatatgagggtggtccttgctcatagtaattatcgttaaaaaaaaaaaaaaaaggaagaacatacataacacttgatgagcagtcaaccgttctgaaggctgagaacacagcatctttctaatcagatcttttccactgtcagatattaaaggccaaggatctgagtcaaaatctatatgtcccttcaatactgcatcaaatataccctgctgggtctctgaactccaaaaaggacaaaactttcagtgatgaaacagatgaaggacaggaaatcaaaagagtgtaggcagtaagatatacctgcccaaaatggcggcacgccactaagcaatatgtacagtatgacaccagctgtccacacatctgcttcaggcccataatgcttgaggagaacctcaggagcaacatagtacggactgccgactacatcagtgaaaacttgacctgaggcaaaggttaaatgaatatttaaacaacaataattagtattaaatggtgttccctaaaatcctaatgggaatacaaatgtatctcaataaaatattgtaatgttgttcttaaaagaagatataaagagaaaagcagagttgtttgttaccgaccgggtttgaagaaaacagagaggccaaagtcaattgctttaagagagaaatcatcatctttgttgaccaagagaaagttttcaggcttgagatctctatgcatgaccccaagggaatggcaagcctcaacaaccccaacaataattttggtcaactccgcggccttcctctcggtatagtggcccctctggatgatgcgatcaaacaactcacccccggaacaaagctccatgacaatatgaacatagagaggatcctcataagcacccttgatggtgacaatgttcttgtgaccagctaaatggtgcattatctgaatttcccttctaacgtcctcgaggtcctccttggaaatcaacttccttttggagatggatttgcaggcatattcaatggaggtagaattctcggtgcataaataagtggtgccaaattggccctgtcccaatttacgaccaagagtgtatagatcacgaatgttgggagtcttatggcctaagacataataggcttggttgtcgaggccgcggcgcatgatggcttctctcttggcgttgaagggaagattgctgttgttgttgttgttgttgttgttgttgttgttttcttgctgcttggttgaggagggatcagaatgggtggtggagtgcttggaatggtcttcgggctggctgaagccctgaatatatttccctttcaaagatccgcggcatgtgttgcccatcaaacaaaccaatttatattatatattcatccaacgatctcctctcatcagcttcttcccctctgctctgctctctctctctctctctctctctctctctctctctctttttctctctctctctctctctctgttgcgctcacctcacaaacaaatcaatccaaaaaaactattcattcatttctttcacatcacatcatctaatttcaacacccacccagacccagcagaaaagaatgcaatacaacaataaagaattacgaaataagcgtaccagaagtgaaggtgaacgacgaatggaaagaggaataactttcgcttctttcttctccgacagatctccacaaaattagtttccaaaattatttctattttttatttctggttaattttaggatgattggattggtggtggtattgtaatttttgtattggctcctgccgagaaacatcggatgttagtgctgaccagctacgcccacttctctctctctctctctctctctctgtagaattttcaattaaatatcacgcggctttctttttcatttcctttcttttttctttttggttcaattcaatgcatccgagatcaaaggggcccaaaacaagacaccaaatctttatcaaagctttagacgaaacttaccttttgattccctattttactaactacaccgtctatctaaaaattctaaattttatttccaaaaaacacctatgagtattttaaaaggtcaaaaccattcttcaccaatttttttctcagattacagcaccactccttatttcaatgcataaatgagagattaaaagcaggatgattttttaaataaaaatttgaacacttctatttaccagaattgagaatatatttagtaaaatatcaatctatattttaacgtgatatttaaagttattgcagccaagtaatggaaaatgtttcttattttcatattgattagttagcacgttgactttaggagatacagcagtcatctatgttagatattgttctaaaatcgtggaatctatttttacacaactatacaatttacatttacattttataaaggaaaaaatgtctcaaaatattctaaaatttaattttacactctttacaaattttatacgtttttaatatttatatttattaaaactgatgtatctttaatttctcattgaagactaaaaacacgtgtttttgttaaatggcaaggactaaaaacataaaaaaaaaaaactcataaggactaaaattagcatttcaatatattttaagagactaacaacttattttaactctttcaaaaaaaatattagattgggaaagaaaactaaccaatgactcgttccaacaggacatgagcaccatcatcaccattgaattctcaaacgaatttcattcatttaagaacaagatatgatttataaatctcaagtgtttatactaaaaaaacatcatgaaagttagcactaccataggtttgacaaacctctaatgtccatacttaaaggacatgcacataaagatccaaaagactttgttaaaattataatgtggccggccaatgtataggcaaggtataaaaagagatagtgagctagaaagaatagaggagaaataaggaaaataacctagggaaacaaataccaaaaaatggaagagagagaacatatcccatgaattccgccaattttgtttttaaaaattgacatttaatcaatagaataataaaaagcatttcgtaacaacactcattgtgaatggcgattctttgacatgtaagcaaatttggatgagattttaaagaaaaagggagccacagccacgggagtcattcattcacttataatctaccttttagcttagccggcacataggaataggatcggttacatcatttttcttgtcttgtcttgttttgttgagtcgaggtagttgtagacttgttttgttttacatcatttttcttttcttgtcttgttttgccgagtcgaggtagttgtagacttgttgtagtagtatatactaatactgtgccgctatgctagctacgcccaatatcaatcagttcagtgaataattttagaaaggaaagatcaccctcctgccctggccccaactttattattatacttttgttctatgtccttttatgcagtatattattcttgaaagttgaaacttccaactcaaactgattttattaggagagatgaagatggctttacgttctggatccgatctgtgaactgtgatccatcttcaatctttcagtaacaaacatgagcggagctgttcttgttgctgtggctgctgctatcggcaacttgctgcaaggatgggataatgccaccattgcaggtcatatttttattcggttagccaattaagataacattcaaccaagtctaattggctttctatgctatgcaggatctattttgtacataaagagggagtttaatttacaaagtgaacccacaatagaaggtctaattgtggccatgtcacttattggagccactgtcgttacgacatgctctggacccttatcagacttgctaggccggcgtcctatgttgatcatctcctctatcctttattttgttagttctctggtcatgctatggtctccaaatgtttacattctcctctttgcaaggcttttagatggattaggcattggtttggcagtcaccttggtacctctttacatatccgagacagctccacctgagattaggggattactaaatactcttccgcagttcactggttctgctggaatgttcttttcctactgtatggtctttgctatatcactcaccaaggccccaaactggagactcatgttgggtgttctttcaattccctctctcatttattttgcactcacactattcttcttgcctgaatctccaagatggcttgtcagcaaaggccggatgctagaggccaagaaggttttgcaacgactttgcagcagacaagatgtcgctggttggttatgcatttatttgatttgatttcatcagttcttgtttacttgcccttgatttggatggtaattgttcttggatatgatcaggtgagatggctttactagttgagggtcttggagttgggggtgataccgctatagaagagtacataattggtccagccaatgaattcagtgatgctgagcagatcaaattgtatgggacagcagaaggtcaatcctggattgccaaacctgtcactggacaaagttccattggccttgtatctcggaagggaagcatggcaaatcaaagtgctctagtggaccctctagtgaagctctttggtagtgtccatgagaagctcccagaaacaggaagcgcacttttcccacactttggaagcatgtttagtgttgggggaaatcaacctaggaatgaagattgggatgaagaaagcattgccagagagggtgatgattatgtatctgatgctgctgccgcggacgactctgatgacaatttgcagagtccattgatctcacgtcaagcaacaaatgtggaaagggacatgcctgctcctgcccagggaagcatgaggcaaggtagtcttttgcaaggagaacatgctggaaactcagggattggtggtggatggcagctagcatggaaatggtctgaaacagaaggtgttttcaagagaatatatttacaccaagaaggtggtcctggatctagacgtgggtctctcatttcacttccaggcggtgatgcgcccacactaacagatggtgagattgtccaggctgccgctctagtgagtcagtcagccctttacaacaaggagcttatgcatcagcagccagttggaccagccatgattcatccatcccaaacagctgcaaaagggccgagttggagtgacctttttgagcctggggtgaagcatgcactgattgtgggggtggggattcaaattcttcaacaggtaatgacattttttgaaacttctgttaatctaactttgatgaaattgtcagaactatttagacatattagaacattttttaaatctcaaaactcattcagtaggtgatctattcattagcccattgtacctagtaaaaagctatgtctgactgtcatctaactcctcttaaacatcgcagttctctggtataaatggggtgctctactatacacctcaaattcttgagcaggcaggtgttggttatcttctttcaaacctgggcctcggttctacttctgcgtcttttcttattagcagtgtgacaaccttgttgatgttaccctgtatagctgtggccatgaggctcatggatatatctggcagaaggtatgaatctttctcttatcattttttgttggcttctacttaaatggtaagatttgtttcaataggtggatgtatcctggagatgattttctcatggacatactgtttccattgcatattttccctgtatgttctttgctagaatattttgcaatttagggtggtattcaataacaaattgggtttgaaattactactattgcaaagtgctctcaaactaaaggaaaatgatatcaaacagtaataagatcaacgattctacatgatcagtaaatgagctgaaactaagtgtgttgtagatgagattgctgaggtgaatgagctgacaaagaaaggacaagattaggatttaggaatgtttttatatccaagggaatgttgaagttagcatctatagataggataatggaaactcgtctagtttgtgcgaagatcaatgaaggatccaatgagaaaagttgatcgaattgaagtgctctaattaaaagacaaagtaaaacttaggaaaacattaggagaagccattagaaaaaaaaagcagcttgcttttcatttcttttttttagttttggtttttgatttagctcagtggtgttgaatgatccatatacattgactccacctagtgaatatggcttggttgtggtggtcctggtggagacggtgttttgttttctattatttgtaagttcctatatgaaagtatttgcgataattctggaaattgtaacctttataatttggaaagtatttgaaagattcagaacttaaatatttgatatttgtgagttatcttctccttttgttgcttttcttaaccccttgttgtgtatatttcttcattgcttgtttttgttcattcaatctgcagtactcattggtgacatttttctatttttatttatttattcagaaccttgctgctgactacaatccccgtcttgatagtatcacttctcatattagtaatagggagtcttgtggaattggacagtactataaaagcttttatctcaacttcaagtgttattgtctatttctgttgtttcgtcatgggctttgggccaattcctaatatcctttgttcagagatcttccctactcgagttcgtggtctatgcatggctatatgtgcacttacattttggatatgtgacatcatagtcacctacacgctcccagttatgcttaattctgtgggccttggtggtgtttttggtatgtatgcggttgtttgcatcatagcttgggtgtttgtcttcttaaaagttccagaaaccaagggcatgccactggaagttatcaatgagttcttctctgtcggggcaaagcaagctcaagttgccaataagacctgactttacatacgacccattggatcttttttaatataaaattattttcaatctatggatttcttgttttgtttcctcttgaggcaccttcatcgtgggctgggatttgggatttgagaaatgagaaagtccaaaggaaactcgttagtcaataaaattataagcatctactataacattcgaatttgatttcataacccttatttattgactttataaaatgttatttactttttttttctttttttaataatacttattttagtccttagcgttagtgcaaaatattatgaagaaaatattaaaatatagtattttataaaattatagttttgtgaagttaaattttagacatacataatgtcaggaagtaaaacgagggtttatacatagaaattagataaacgttcatttttaaatcttgttttatgcggcagagatgttagggaaagtaggaatttttggtataacaaaaataggaacggaaaattttaaggtgtctaccatagaaattatagtcaatgttaaatcctttttataagaaaggtagtattttttttccttaattataaaaaacatttttaatttttgacaaaattataaaaaaaaacatataatcactttaaaatgtattaatgagtaattttcttttatatccttgattcattgtgaaatgaagatcactttttttattataaatagtgttattatatctaactaattcttaaataagttaattttatgagtattttttttcaaaaatcttgatatgaattaaaattatctaatttaactacttatattgatcttgataaattggataattatttctagtatataaataaacttggtatttgtttatatatacagagaatcgaaagtaatataatcggaaattgtgttaagtattataaatattttgaatatgttattattttaatgaattaaaaccaagcattagacacctagtcaaattaaacatcgaatctattttgacatgaaatatcaaactaattaagcacaagatcaaacttgacatcaaacaccaagccaaccaaatattaaggattcgtttggtaagagagtaaacgagaaaaaagaaaatatgactaacgaaatattttcttatgtttgtttagatagaaaatgaaaggaaaaattattttttaataaaaaatttaaaaattttcttcttttcattttctttccaattcaaattttaaaattttccttccttccttatttttcttccatctaaccaaatataagataagtcaaacttaacattgaatatttaactaaagtaagcatcgagccaaacttgacactaaacaccttgtcaaactaagcaccagatcaaactagatattgagcacctaatcaaactaagcatcagactaaatagacacctagccaaactaaggaccaaaccaaatttaatattgaacacctagccaaactaagtattggactacacttacaccaaacatcgagccaaactaagcatcggatcgcacttgacaccaaacccgatgaaaagatttaatagttaataaaatttaaaatgaaattataacaaaaaaaagtattactgattataatttaattttgatatgttgtcaatatttttttttatagtgttattgttatattaataacaaaatttgatttttacatttaattatttgaaagttacatgtttctaatttgactgcagaatgtataaagcatgttacgtaacgtcaaaattaaattgtactgtattacacatgcttatagttgtgtaaacatatacgataaatataaaatagttttaaatatgagggaaaaagccattacatttttttaaaataaaatcgtatatgtttatatagttgttttagactgtacatctagaattcgacccttcaaatattatgatgttttattttcatttttgttaccaaattgatttctagtatttggaaacactttatttgagagaaaaaataaattcgaaagttttaccaagatgtaaaaaattctttaaaacatcttaatttaacatgtattaagatcatgatactaatcctttatttctttgttgtcaaattcatttcataaaaatttaaaataatcactaaatttggtgttattaatttaaccatttgaaaaaaaagaataaagtgatattttaaatttctaagtaatttgatagtaattttttttaagcaataatattataattttgtaaaagtctaatttagtaaaaacgaattgagaattaatgtgatgactacctattcgttagaagatgacctagtttaacaaaggtaaaattagataatgtttacatatacctttttcttccttcaatgttcaaatacagtaagttcaacaaaatctttaatacaaacaagggtaggaaaaagtgcacagattctttttcaaacttattcaaagaaaacagaaggaaaacgcggtaacaaataaacaatgatcgatcttcagctcatcataaaacaatggttctttgagcaaccatacatataacctaggaacgagctttcgaattgaaatccgtgatgaaagcctccatccacataaactcttagattaaccaagaaagaattagaaaacattgatagtgacatgataaagagaaatattaaggaacaatacatgctattcaaaagctaagattaactagcgtaatgaaacaagaaaagactaaaaatgacttctttttgagctttgtcaactcaagtagcaaaacaaaagcaaagaaaatctaaaacatgcttttgagttcaccataacactgacctgatctaggtcttttcataattattcatctatttaaatttccaccacccaaacagagctcccagcttggttttaatgtttctctttttattcagacctccacactagaatgctgcttcattgatcagatcaaatttcaaatacatgtgtgcggtcagcacttagggtgttacgagcaagttggaagaaatccggatcttgaaatctacaagtctctctctggcaagcataataaattagaattcagtagctgatacaaaattgtcaaccaaccatgttgtttgttaaaaacatatatacgaataagaaaaggccgtgagatgcatttaattagaaaatcacaatcaatttcaagaagcttagaaaagaaatgaatgggggttgagatgagaagaaagaagtaataatgaatttataaggtagaccttgtgaaatcataaggctagttaaaaaaagtagcaataataaagaagattagaaaaggccttggttgtcgtatgaatatcggttggagaaaagtgaagaattgggcaaaatcatatagcattaggaagaacagaagcaagtaaaagtataaaacaagcggtagagaagtgaagcgtaccatagagatagagaagagaaggttcaatttggaatgcgtctagcaccaaggcgatcaagctgcttgacatatgcagaagccttcaaattgccttcatggagaaaagcgtcaatcatgtgtttggcaatgaggtgtccaatttgctcgtcgtcaatgacggcgacggcggtagggccggcgccgctgatggtacagccaaaagcaccggcctgaatggcagccctcttgacagcctccatgccaggaatcaagggggcacgccttggctcaacgatcttgtcagaggacaatgccttccccaacccaaccacgtcgccctgcagcaccgacgccaccagagcacctgcctggctgcagttccacacgtggtgcggcatcccgatctccgtaggcagcgctgcccgcatcttcttcgtcggggcctcgaactcaggcgtcaccagcacgaaatacagctctttctccgccggaaacatcaaaggcatcaactccagcggcgagtagctaccgatcagcacaaaaccccccattatcgacggcgccacgttgtccgcgtgataccccgacaccttctcttccgatttcagtgatgccagaaccagctcctccacgcctaatttcttcccaaacagctcgttcaccgccacggcggccgcagcggcgctggcggcgctggatcccagtccgcttcccaaaggcaggcccttctccagggagagggagaggccgacggatcgaatggagagcattttcatgacttcaatggcggcgatgccggcgcagttccagagagggtttttgctgagcttgttgggggcgtggccgctgatgtcggatatgcatatctcgccagggtgaacctgtgggtccaccttcaccgacacaatgtctccgagtccgtccacggcgcagcctaggaagtcgaatcccggacccagattcgccaccgtggcgggagcaaacgctttcaccaatgtggttacaggttcgggctcccttcgaatattgactgacacgttgctgctgcagcatctgattctgaatctggccctgcctttcaaactcgccgtagacggacacaggaagcacgtcgtcgacgtcgccatctccactcttgcgggtttgtctcttccaaattataatcctaccaactacgattcaagtaatgtatttcaattaaatttaaaatttccttttttactttgtgtctttgtttgggtcattcccatgcccaaccaaaacaaaaattgttggtactttaattgggagtccatagttttgctgaaactttctaaaattaatttagaatttttaagaaatatgacgaaggttttattttaaaattaagttagtaacataatttaattttttttactcaacttaaaaattattttaaataagtattaattctaaaaccaaaatcaattttttaatctaaaatcagttaataagaattttaaggtaattttgaatgatataagatagatccaattacttttttttctttcaaaaactaatttttatctgcccatttttttaaaacaaaaacttaagatgatattaattgttattattttattaattatactcttaccattatctattttttaatatttattttatccatttattataaaataattcaatttatcgattcaattaatatgttacattatcattctaattagtattgacaaatacatcacatttttcgattaacatatttaaaacaaaaaaaaaaattgattaaaatgaaacatttcaaaaacataaaaaataaaaataaaacttttaaaattttatgtaacaaaactaaaaatattaaaacataaataatcaaaagtatcatttagcttttattcattgaaaaaatattgctatagtatgtaaccgctaaaatcaagttgtgtaaatatgcatgattaaacgaacacgtttaactataaatgtttcacactagcttgaacctagatgcaagtaaataatctgtaatattactaattaattatgagtgcttatatatcttcaccagaagcaagcagaagttttggcttcaacattaggtgagtgaggtcactaaaaatgtctggatgcgtgctgaacggagctgcaatgattagaaataccaactttttgaggggttttcttattgaattgccgtaccattgatgaaaaaaatagacaagaagcgccaggaaacatgttattccacagattagaaacaggccccagaagctctttaattgaagttgttaatcctcagtactgtgaaaaccacaagccttttctgaaagccacttttcatggatcctttgaagttctccattctcagatagggttagaatcgcagttgacatatcaattgcaagaggagtctctcgggaatgcctgccgtgacacctaagaaattaatcaaagacaagtagtaacataaagatttacaagtacatgaattgcagttgagaatcatctaggatcgagtagtactgaacttgagcaaaatttgtgctcaactaccatcaacatatatagtgttcattgtttcattcaaagaagctaaagggaagcgaagttgtgatttattgcctcccattttataaaatatcataccttctaacatcatgttttgctttctgcattagtagttagtgcaacaaagtacataaaaaaccacaccctgagaaaagtaccagtaagtaattttaaaaaatactcacaaatccccatccacttttggtgaactcctggccccttattgagaattggcagtggtttgaaaggaaaagttctacataggatcgttcatccactacagctgcaacagttccgctttcaagggcgacagcatattcttctggtgagcgaagaggaacaagtctatgtttagggatgttgagttgctcagtgagatagtttgcagcaaatgagcctacttggaaccctatacgttcactgctggatatcaagctatcaattcctgttattggtgaggacagctgttgcacagtgagaattgatgtcaagcttgcagtgtagcttgaattgattatcagaaccacaaaaggccagattatcaacacaacactaccaagtggactaactgtgttttctcctgaaacaataataaagaagcttatctgtttctagccacaaacatgaataggacatgaactgtcaaaatgggtggacaacttactgtgcgcaaagaacatggttgagaaactaaacctgcaacagcatacaaagatgagttatgaccagactagatatgtgcacaagctacaagagtacttaccaaagaactgtaactatctgttccctcggtgacccccgaaactcattgtttgttctatgttcaagaatccacaccactgctccaacaaaaaggaaaaaaaatgcagtgacacactgacaccacacatctgtggagtaaatggttgtaacatcccgggcgctgacgagcgcggggagtgatcgccggtgcagtgaggcacggacaaggagcggctcctggcaggtaccagcgggaggggtacatgaatgaatcaaatacacacccaaacgagagggatccagaggctgtgcaggtatgggactgtacagttgaggataacttaaaggatttaataggtactacctataccaacaaggtgcatctacttttcggtagcccataacataagaacttcacagttaagcgtgcttgacttggagtaattatgggattggtgacctcctgggaagtttctcaggaagtgtgtgagtgaggacaaagcacactgaaaagtcttgtgttggtatgtagggacgcaagtggccgggcgttacaagtggtatcagagcaaggcctctctaccagtacggtgtggttcgaggacgaaccaggcggaagctggtgggcatgtaacatcccgggcgctgacgagcgcggggagtgatcgccggtgcagtgaggcacggacaaggagcggctcctggcaggtaccagcgggaggggtacatgaatgaatcgaatatacacccgaacgagagggatccagaggctgtgcaggtatgggactgtacagttgaggataacttaaaggatttaataggtactacctataccaacaaggtgcatctacttttcggtagcccataacataagaacttcacagttaagcgtgcttgacttggagcaattatgggatgggtgacctcctgggaagtttcttaggaagtgtgtgagtgaggacaaagcatactgaaaagtcttgtgttggtatgtagggacagtcgttgatcctgcaagtggcagggcgttacaatggtcgcaagatgcaagtgcaaaaaaatcgatatataaaagcaagatattactacattatgtttgttctctgcagtgagcattacttacatcagaagtaatcatgttgataagatcgtagtagcttgggttcttgtgtccatctccaaacagaatgaactgttattgaactgcaaagggaagcaatttaacggcagctaggaatatatctatatgcaatatccttgaactgcattggtgccatttatttgcgagaccgtgtcttgatagctaactctgttgagaactccaattctcagttgcctcccattatttgggaaaacccatccacgaggcttttctgttgtatttcctggccatatgacaaggtttagatgctggcttgaaattgaacgattggcaggctctgcgtgaagtttctcaggggttattatagagaggccagagtaattagaccagtagccgatactcctataacctgtagcaattacattaaggatgtcatatgatggatttagaggagatctatctgaaccaaattgaataggtccagtcaatccagtcatattaatgcgcaatatgttatcaagtaactgcttccctccatcaaaaacgctcaaagcaccgaaatccagagcctcttccctcgtaccacttaagtttgtattgttagagaaggaaatggtaccattccgatcaaaaaaaaaaaaaattgagtaccttagcagtcatccaaacagaatcatatgcatagaggccgtatggatttaacccaattgagccattactgatgtgtttccaccttgagataaatgcctgtttttttctggattgaggggtgtgagggcaaaaggtaataactccttgaattgagttacaagtatctgaaggtagtgaagtagttgagtctaaaatagttgataaccaagcagtagctatccagacataccctttggtcatcattcctagcttttgagccacctcaaaaaccaacagaccagtttgcgcgaaggtgtttaagacgataacccgagactccatactcttgatcttcactaactgaccagtaacaggggatggagtggcagtcggatcaggaggcagtgctgctttgtaagacaacttacagcgtctctcagcaagtttatccccaaaacggttatcccattccgactctgatcatcgtcgctgaaccctgctatgacttctctccaaccaaaatagctaatgaggtcggcaacggcattcatgtggaagtgatcggtgggtgctgtttggagaaaataaggatactggagaggtgttagggtggggtccagagccgtggagaagagtaggggaacatggagctcatttgcgagatgcgaaagcacatgggccattactgaagattgtggaccaattatagctactgagtcggtcatcaagaacttgagggctggaagaattaggaagtaaatgaatatatataaaataaaacaagcaagcaggagcaggaagtgatacatatacatacccccaataaagccaagaaaaccactgaagttggaagcatggatggttatggacaatttacgtcccaccaggatgccaggatcggaattcacatctttctcagcagcttcgatggcaattttggaaactcgtccgtttatagttttaaaagtgaatatggcaccgattttgacgacatcatcatgtcctcttgatgctccatgtaataggatcaatgttaataatgcaacgcatagcaaattcatccagaaactatgattcataattatatatgtaatgtagaggaggtcgagagagaggctactactgctgctgtttgatttgaatgggaagtatagacagacaatatgaaggaatgtagagtgagtggtgaagagatagtgatagctttaactgtagcgggaggcaatgaaagcagaaaccccacgtcacgcgggtagagggccacgtccaacacagtaagtgggacggtgtctgagtgagcacagcaagggccattttgactgacatgaatgcaagcagattgtgacgtttcatttatcgtacttaatttcaacgtttcaagtttgtacaagaatatatctgtgtccttgctatctcgacagctttcacactttatgatgccaagaggaatttatattttctttttggaagtttatacatctttccctctgaatgcatgtatgttttggtttttcaagtgagtttgggtacaagtttccaactctttgatcctaacccagaaactttctatttaaagactaagttaggtaataatttatgaggggattacacatgtacaccaattataaaatatgattaacctaccaaacgtcatattactgttaccaacttcatcttttgctcaaggactcccaattaagcaatatccactatgaagtaattcaaatggcataacttagacgccaacaaccttggtgttttgtttgagtttttagcttcttcatattcatgcatgtaggttaaaatatgattttggtcctaatatttaagtctcttattttataaaatggaggattttgatcccataagtctcaactgacgttgacgattaaataaaaaatgctgaccattaatttgttaacgtgacactataatattaaacttttaattaatgttttgatcacgacaaaatttaatttaataaaacttaattaaaaactaaaatatataaacaatttttatttgttcagtttttttattatcttaattaattaactaaaaactatacacctttaaataaaaaataggcatgtcaccgcagtcaacgctaaacatatcagtcaatggcctgaattgatagttgaggccaaaattctcaacgtagtaaaagagagagactaaatatttttattttttataaaatataaagaattaaaattgtgaattgaataaaattagaggaataacttacatctataatttgagactgcagcctccatcccattttggttccaggcttgaaaatttggactagtcttataaatgctaattattgaacctctaacaatttctttgtttgcacattattatatttcttgttttcttttaatttttgtagattcaaccatactctactttactcgaattatttttcaaaataaagagtaggtttaaatttgtttaaatttcttaatgactaagcaaacaataaatttatagatgatgacaatttagtttactgcatttccttttaattttaaaatcctccacccaaatacaacataatttgatcagtaatctctccaataagaacttactacaaaatcagaaccaaccccagagttctgacgaaattagattgaagaggaatgctattaatttcagtcactaataattacgtgaaataagttcagttaataatgaaaattgtgttaaaaagtatattgtttacatttcactaaatttaattggacaaattaggttcaagttatacttcaccacatatatgacaaagaatcataataaaattccgctcagtaaacaacactcaaatcagatagtcatcaataccacaatctcttctacgggactatggaaaattaacaaccaacaaacaaaaaatatagacaggccttcactttcattttaagaagggaagtaagattgctggactggggacaaacctgcgcccttccctaaagaaaaagtgaggaacaaggaatacacaagattaaatacaagaaatacattacacataacaggttccagatagcaagacagacaacccactccaccagaggcaacagtcggaaagtctgaaaacagaaagaaataatgcatcgggtggaattcctaaactaaaaagcactccaattatcagatcctcgtcttggagtttcattatcagatgaagtcctaaacgggccagagccaaagggatccgagtcatcaaaagctggaaacccatgagcatggtcaaaatccacactgttgcgtactgaatcatattgttctgtcttctcccgagcaggcaaagatacactatcatgtgttctgaaggaatcaaatcttgagaagtcaaaagcagtttccaaccactcttttggcctttgcggagagctacctgagctgtaaagtggtgtgcttggaacagaatcatcaaaactgaatccactgctcctctggaagacatcaccagcctgtggtgaacctgttttgatggggtttaagtccagttccccagaatcaaagaaatagttgttcccagctctatcaagatctctctccttttaaaaaaaaaaaaatccggaaagtaatgagtagattgctagagtataaatatccattgatcaaacacgtacaagcaactcaaaatgttaaatttaagaaatatattaccaagtacattaacagaaggtgagggttcagtatttttagtcaatcttcaaatatattcaattatatatctttgggctggcagatctagcacattcagattacattatgctttctcctctgatcccatcaatcctttgcaaactggcttccatacttttttgcaaagaatgacacatctatccctttgattttaagacacaatcataaaatcttataaaagctctgaattcctactaactaaatcatcatgtcttcatattccatcacaagtatcacgtaatgtaaccatttagatctccttaacatccaagtcatattctgaacaaccacatggaggccaactaatgcttggttcgattgaaatctataaaaggaaacaaaagaccagcacaatcttcatttatctggaaaaatcctatgatagggtaccacaagaagtccaatgtaaaactctagtgataaggagtttgtattttatataataaaattgtaaaggatatgaaatggagttatcaaaaaaagatttccttacaaaataggtttgcaccaaggtcaatttagagtccaactttttatcttaggcaataaatagcgagtgaactaatagagttgtaatataactgtagtcttgcaccaagggtcaacttttcgtgcctctatcatggtattgcacatgcttattaggcacaaccaagagtcaatgtctcaattatggtaattaggcaattgctgcatataaatatccttaattatggtaattatgtaattctatgagttacataattatggaaattaggtaattattttctctttaattaaattattaaacccatagaccataatatataataatacaccccgctgtgtacactaacacatggattcaattatgtatcttactttttcttcttctcaacatcaataaacactttctacaaattatatatatgggtctgtttgtttaagctcattttttaagaaagcacttttttaataaaataagcagttttcttcttttctgatgtgtttgtctaagctactttttcttaaaataagcagtgttctgttttttttaagaagcaaatcctatctacttcttaagaagcgctttcttataaattgttttttcaagtttaaacaaaagggtctgataaaaaaaagtttaaacaaaatggcccatagtcctagttgacgagtgaagaaaagaaagaaatatagtaaacttgaattgtggaggaagactaccaaatgaaacatgatcaaggttttgtctcaaaattctgttttgaatgggcctatcttaactgcaaaagctagctcttgaaattaccattgttcaagcccttgttctactatggttgtatctatagtcgatatcggatctcaacaaatttgaggtttattcagtttaaagtttcacaataatgtgttatagataaattagaagaaatttagtgtatttgagcctttctctatatgcttttgtcaataatatcttgattctttccaaatatgcatacctcaaatgatgatttgtattaccacattgactgttctcaatagtgacaatttcctagtatgcatctttccagtaatattttccttcataggctatgtaacatcttgactatcttccagatgagcatcattctaacaatctaatcactatgttgtctctattaatgctcttttttggtcaaatgtatttaagtcattgtttgggaaccctaataacattgtgtgctttggtgagcctatcaaagtttcaagatgccgacatactaatcttcaactagggggagtgttagaatattaggaatatcattattgtgtaaagagtcttgtcatgttacttatacaacatttgttacttacttgaatattagcattcattgctgtattagaatatagtgttgggttagtgttttcaaaatattacatctcaattcagttagttacatatactccatatttcaacaaccaccagtggtcatgacaagaaagaatagtgcaggagaaatttaaacacacacacaaacacctatatatatataactggcaaacacgtgttttgaaataaaaaataatttggccaagacattaaggtgtgagaattggcatacctctttagtgaagctactagcattgaatccccaaactgaatcaatatcatcatttgtgtcaaaggttccccaatttggttcatcaaaaattttgtctccagaaaacgcagatttgacaccaccatgatcactacatatgcaagattatatgtaaattattttgcatcatcaaaagatccatactatgtgaaaatatgaaacaaaatatacattggtatctattaacactcatgtatgtcaaaatcaatttcaaaccaaatttgggaattaaagtccgtatcatgcactagaaatgttcataggacgggttgaaacaggtttagtttgatccctaaaaaaaaaaaaaaactacataccccattgctcggaggctccacgctatgcgcaggtaagggggagggaaattgtacgcaaccttacccttgcatatgcaaagaggctgtttcgggattcgaacctatgaccaacaagtcaccaagacacaactttagcttcatccttacctagttaaaaattttaatagggtcatttgatagaacctgaacctgaatgtgtgtatgctgatgatagtatcaccattcaactatgacttgtataaaaaaatatgatagtccaaaatctataaagtgatgatatacaacaatttgtgactctgttaaacacatcatatgagagatgacagttatgaatgactcttgaaaacttgctaaccgtgggtctctatcacacactcacataaaatccctttgagttgaagcatggaaatgcacaggctcatttttccttgtgctaaagttataatatgattgaaaaaaatggggcagcacaaatcaaacttttatccaaacagtaagaggctgtaaaaccatgtcaaggacaaatcttctagaagaataagttgttgggtgtagaccaaggagtctttaacgataatgccaccgtatttgtcaacatcaacatcaacatcaacagcacctttaacccaaattaattggggtctgtggtagatgaacccaatgatagattggaaaaaaagacaaagaaagagaaagggaaatgggaagaaaaaaggaaaataagacaaaagaaaggaaaaataagctaaaatagaagaaggatgaaaggaggaggggagaaatgaagaggaaaagaactaaaaactaaaaaaaaaggaacgactggaacatatacatactaatgggtttaaccctccaccaagcttatagcttttatccactccatcctaagacacatcgtccgccaatctatatcccactctattaggtcttgtttaattacctttccctgggtgagtttcggtcgacctctacctctctttgtgtcgacttcttggtaacaaacttttgttctaatgcgagcatccagtggaggagtacaacatatttgtacaacaataataataatagataagggatcgagttactataggaggagtaactctttgtaaagttactcccttcaataactctatatatcaaattttattaatccaattgttaaattaaaagttcttatttagtacatcaagtctacaattttttataaaattataaaactatttgatacttcgttaaataaatttaatttaaaatataaaatatttttgtaaaaatataagtaaatgttgagtataagattacataactacaaatatctgatttatataaaacttgatgtgtgtggtcattgaatcaatatctaaatattcaatggtaggaataataaaaattcatataaacaaaaagttatttaagacactaacaaaaacaacaacaacaatattgatgatcatattattattattaaaaataccatgaccttccaaaggcataaagaatattaatggtcagcaaaataagaggacgcctactaaatatatgatcaaatgagcaattggccagcatttgggaaactggtgaataaatcttaaaaaccatacctttgggtttcttgtatggtatcttgatcacggagtaagctatcttcaccagctgtctttctaatgtcagaatcaaaatccccatgcgggcttccgatagcactgcttgcaaatggactattgggagcactttttacagacccatcatcacttttattataaacaaatccattgccaactccctgttcattggtagtctggggcttttctgacttatcatcactcttgggagaagcagcaaatgtaggactgtcagtgctcacagcttccgcgttcacagctttcgtgttcacagctgacggcaacttttgctttggaggcgctataatgttttgcacgtcgagagtgagttctttgacaaaaacaaattctgcaagaatagtgaataacaaaatttatttagtcctttccatgataatccaaacaagaacagatgcaggtcagaaaataaacaagtatcagttaaccgttatttcaattcaatcaatatcttataatatctcttaaatatacacctatttttggaatgcattgtctcctgaactacataactgttcaaaattgatcccttgcatttagatgaacagctacacttagaaaataatgacacaacaaagtacagctaagtaaagttcatcagcaaacaaagtacttagtgtaaaagaaatatagatataagagaggtataggcaagcagagaaagtgatagaaactaaggtctgtgagtgcatagaagagagaaagcgatagaaactaaggtctgtgagtgcatagaagagaataatttacaaatagaaaaaagactggccagattctattgggtcttttgatgctgcaaccaattgtaaaacttatgagtaccaaatttcattatccctcacccattaattatttacttgccacaaaggttgcagatcagtttgcttagtcttctgatattataattttctttcagctattaaaaatgtctgtcatgagtaggcatgccttaagattcagctcttacctcaatgttgcaatttcttctctgatctgaagagatattgtctgcatttatttccttaattattatctctatattctttattttttgtatttgtggacttatcatcaattaggttgaataggttcataaaaaataggaaaaattgcaattttggtccccctttaattcttgatctgtgattttggtccccacattttagaatatccataattttagtccaatcctcaactttacatacattttatttcttttattttggcccaaaataaaccctagatctaacatattaacttaaggtactatcaagtatcaagaaataatttgattaattaaaattaaaaaataaaataaataaatgtatgcaaaattgaggattggaccaaagttgcggattttctaaaatgtggtgactaaaatcgtggaaaaaaattgggggtccaaaatcacggatcataaattaaaggggaccaatattgcaatttagcataaaaatattacataatttggtaaatttgtttatataaccctctatttcctttccctagttcattgccttccctttcctcccaactttcgaaacatatctgatgtgattactaggactaaaagtgcaaataaccaaggaagaacagtaaaaaaatgataatgcattaaatcataatgtatcacatatacatgctgtcaattttattaatgcggaagaaaatacagatggaaggatgaaaaacactaagcaaaacaagaaacaagtaatacagactttaatacttcacaaacaagttttctttttgagatcaaccccttaaattataagaatgacaaaaaaatatccttatcaaaatgcaaatgaaatccaattgagtttgatgatacagaaggtaggcagataggcatccaataagagcgtataaaataaaaatgtggtttcataaccttgtgcaaaaattcctcgtaattaatgatggatgccacataattggcacagcatttttatttttattcaattaacagattatcatatctagttagggttattttggatacctttatcttcaagcttatcccaatcttcatcccagtcagcagctccttcttggataccaggttgccagccttacaggataaaatggagtgaggctacagaatacaacaaactcgatatgcacataattattgcattattcaatataatatatactaaggggagcacatggggtttgtgggcagagcaccacaaagcaaagagaaatgatgggacccgactaaaatgagcaaaacaagaatacatgataattatatccaaaagctaacaatgcacttagcaagtaagtgaacaaaaaggaagcaagttcatttaacaaaaatgaagagacaatttgtaggctataaaaagttttctgagcttctttaggagtatacttacccggtgtaactcttccttttcttttagtcatgttgtgagtctaactatagttggtagttagactgctattagttagacagttagttaggacagctgtttgacagctgtcactaactaactcaagttagttgacagttacataactataacttttgttttcttttgccatcaagtgggtttctctagcttgatctttggcaccttaattcaggttttatcatgtattaggttgccaaagctttgttaggcttactgatggccttttctttctttttcagtacttcttgtacttcttttcatatatataatatattatctttgctgataaaaaaaaaatataaactgtattgttctcagtttctgtttgggttgaatacaatattctttcacctcaatttagttctctctcagttttactttcagattcatttagcttcattaaaatcatgatagataaatgcaatcatacagatacagaaagccaacaactaaagttttttgtcagagcaatataaataaataagcattacttaatagaacaccaccaatatcaattaaatcaaatgtattgaagatggaaatgcatagcatttcttgcatactgttctcagaaacatcagagagtttcaagtttcccttcttttcataaaatcaatgcattaacccaacatttgatagcaagtacagtagcaactactacaaagaaccatataattatataagcatcaatacaaagcatcatcatatttcttagaatgtgggtttggccctaactcaaccccaaaagctagctcatagggtgagggttgttccccacttatatactctatcttgatgctatctctagccgatgtgggacttgggttttccccaatacatcccctcacgcccagcacttttgggcttggtacgtggataatatggtgggtagcccgttaatggatctaagataagctctgatgccatctaagaatgtgggtttggacctaactcaaccccaaaagctagctcatagggtgagggttgttccccacttatatactctatcttgacactatctctagctgatgtgggacttgggttttccccaataatattgtatagtaaattgattccctaaaaaaattgcacaagagaaaacattcatgataaggagcatttcctaaactttatatattaaatgccacttgattaggttatacagtttattctgattttatgtaacctttaactgattgtttacaaagcatcatcatatggtattttatagagcttgtcaaacagagctttgcaacaaaatcagttaaaaattacataaaatcagaataaactgtatatatttaatgccacttgattaagcaacctgtatcaaatttcactggcagaaataattttactgctgattcaaaactagtaattcagcaactgaaggccagttcctcaaattacaaaacaaagctgatatctaaaacaaatgcactaaataccatataacgaaatcaaagacacgaaaaagatttgagaaggactggaagtatataacaacaccaattataaatttgaatttaccaaagggtagctccaataatgtagtgggtttagcacgtaatccatatttcttgcatcgctcattcagagatttcaccagctcatcaaggtctgtttgaatacgatcaacatgagcctgaaaatttcagatgactaaatgagatacataagttgatcacaatttctcaacatggatgcacaaacctggtaatattaaaatgtacctgcagagttgcatcaccttttccatcctgttccatcttgacaattgcttggtacaattcaatttttttctcctacacaaaaaaaaaaaataaaaaaaaatcatttgacagcaatgaagcaaaacaggtaaaaaaaaaataacaaactttttagcatatatgcttataagctatcaattgaagataaagccatatttcattgcacctgtatgtcacgaaacgtggcttcctcagtagttaacttggatgataaatctcctacttgcttatatttatcttcatatttctttgctaaaatgtcaacctgaaattcatatattgagcaaataataaatattatgattattgaggtaataaaaacacatgcaattctaaagaaagatacctcatgcttatcagcagctatcctttctatgacctcattaagacgattgtcacatctgcttttgtacagaaccttttattggcaaaagaacaagtaatttgtttaaaaaaggtgaaaagaaaaagaaacgatgaatattaagtattaacctgacactgacactattaaccatacgaacaaaatggaagatagcttttatatgctttactcttctaggtatccacaatttcatagtacaaaagggttacaaaagaacatgtctgtttcataggcttttttttttccagtagttcctaggtatctgcagaagcagacaaaagctgaaagaaaagggatagcatctattaatgcataacaattaagtaaaagacctttccaagagaccctttttcacttccttaaaattaataggacaggaaacccaagaggcagacaggtgatatgtaattatgttcagcagatctatagtaaaaaatgattagtttggttaacaaatctggatattgacaataagaacaaagccatgggatgtaggaatatgttcttatatatacttaaaacaatctgcatatattttgcacccttaaagctttgacagtaaaatctctttgtaagaatgtaagatgcattcttcctaaagtacaataaatcatgatggtgaacaattttttgaccaaaatacatttcacaattactactactagctacatcagtacatctatatggtatatagctcatcctgcaaatcaagatacagtataaatgtacacaaatcaaatgttaatctgttaagcatattctaaaataaatctaaagcttggacagctaggcaaggcgaaccctgtacagtaaaagtttcagctattattgatccagttgccacctcttcaccatgtttggatgacataaaagagactaaaacagtacaaaaagaactcagataaaccagactagagttttaaacctcttttatttaagcttcttttatttttttgaagaaaaagtgctttttaattaaaatggcatcttaaaagaatttacaatgattatattattgtaaattttcaaaaaagaaaaacttcaaaaatgctgctctagtggttttctcagaagcaaaaaagagtaacttctgaaagaaagctctaaaacaatgcatcacagaaccactttttctatacacaggccttaataaaatacaaaggaagtaagcaaggaaaacactcacaagttcctgcatttttgcacggtaaaattctattttctctctggactccttaatttccttctcaagttcttccacctgcatttaacaaagaaaatgaagagatgagaattgactatgttcaattgaaccacaagaattttatcaagcatacatggaccgcaataatgatatgcttcatgcaaatgacaatctacaatatgatctttccacgctatcttcaaagataccagtaacagctaataatttttgtagctgtaagtttcaatcatcagccaaaaagagtaagcatgcttcatgactgaaaccaaaaataacttaatgtcatcacaccacatcctcaaattaattgacctgaaaagattatcatagaggacacattccccatatttgtgatcgcaaagaacctactaagctgaaaggtaacttttatcttattcctatattactgaatatactctatctagagtagtgaatgttgaactttaaagggacaataaaagaaaaaagtgagagtaaaagaaatgataatattaaaggatgtgaccacagaaaaaagaacagaatatggaatgattgtatatgagattatgaggagatattaatgtaacatttatcaaggaaaaaatgacagaaaatttgttaaggtggtttagacatgtaaagaaagtcgctgaaggcaccagtgaagagagtagatcgcatgacttttagccctataaaaagtgcaacagcagaaatgattcaaaaaataaataaaagcaccttcttatcagcttctgttgcttcttgaaactttgaattaattgaattttgctcatctgaactcagctgattaatgaggtgcctctccaagactggaattctagatttctgcggcttgttctgaggtccttcatccgactgagagacagcagccggccttggtggccgacctgcagcagggttcacttgtcgagcaccagaaccagttgtccctggttgttgttgaaaagcttcaaaagataaaagggggcagagacacaaaaataagagaaaaatataaatttatcatttatctgaagggttatatcagtaataatctacaatagtggtattgtagtagtagtagtagtaaaataaaacctgctaattcttgggcacacacctgatggatttccccaactactatagtgagcagcaggttgaccagtagttggtaaatcaagcacaatgttacttggaagtacagctggaagaacgcatccttccctgtgtcgctccattaggtacaatgcaatacaaaactccctgagagaaagcatgctatcattatcttgatccgataagtcccagacctgctttaaaacctctgaaaaatataaaacatggcataaacataatgttcaagaaattagctagccatgaaaagtaatacacatggaggatgtgaaaactaaatagaaccccccaccccaaacagacacaaaaaactgctatcaaatccaacttagttcggaaatatgtttaattaatcatatttgagttgatttcctaatgcatgtagagctagaacactagagaagtagaaaaatatatatagcgttttaagccaactgtccaaacaaaaaggcaaggaagtagaagaaaaatacctcttggtaatctccaactaagaaacaagttccgcgcttgttccccagtgattttaccatctctatctgtgtctacttccatgaatactttcatatatttctggacatcagtttgagtcatccttggccatggagcttgggattgactggaagcagaatcctgtaatctccctggaagtccagatgaattcggcatattatgcgtctggagtgaggcatgctggtcctgttttaccaccagctgggcttgctgaagctttgcaccaacaggctgggttgcaagtgagcgctgcaaagaatcaggagtactagtcctagtagaatgctggtttcctccagatacaggaacaatagctgaagaaagcgctgaagtgccagaagaaaatccttgtggagaagaagcttgcttgggctgaaatgagctagctgagaataaatctcctccaaaaaatgaatcggaagaattaccgttaacagaagtatccactggtttagaatccttaaccaattgatctgatgactttatgggggaggcaggatattggccaggtggccgtgccacatttgatccaaacccaaacccctcctgcgttgatgggggactagttcctctaactgctactggagagaaagttacttctggagttccacccatcttgccataactggaaatgccgggggtttcagggcgagccattccttgagtggcaacagcagctggaggcctcgcaaactgatttccctgagaagggagggtttgctggttaccactcaaatttgaaactgccccccttggtccaagattttggtgggataaaggactaacaggaccaatctgtggcgcaggtccaggtgcaggtgcaggcgcaggcgcaggtgcaggtggagatactgtggcactgaaattaatctgaggagcaggaatcttagatgcagccgggccatacaatgctgcttttaccatttcgggagttagttcccgcttactctgtgccacagtaacaagcttaagggcattgtaaaactctgcccgcccaaggaaaccactctggctttggtttgcaaatgcccaaatctgcagacacacagacaggtcggtgtgatttctcaagtatttagcatttagacgaacagatttctaatgcagtgactaactaattcaaaaaaaacaatgctctgaaatgcttggtggcacttgatgtgaagtaaatcaaataataagcagaatttgaattagaatagagggagagagacctgcgcaagaacatgtttgggcaaaccggagccctggaagaaggagacggcttcggcaccgctgatacggccgtctcgatccaaatctgcacggcgaaaataggcatcgaagagatcgacattaggcgctgccgatgccattgcagaattcaacagcaccgcctgatttcaatagattccacacttttttagttctcctttgccttttcagatcacaccatgtatttaattgtgattcataaaagctcaacaaacatcaaatttcgtaccccaaagattgattaaccgcttgatttgcactttgcttgcctccaatcgaatccgatcaacacactcacccaccaacaaaattacagatcatccctcgattctcatttttcgcccaacggacaattttaatgctctttactgtctgaatttcaaaaataccacccctcgtcacatttttggggagaccctcgccaactgcgactatttctaagtttttttttttatgtaattaaagtttatatttataataatacataaaaaaatataaattatattttaatttttattcatgattttaggtcattttttattatcaaaaataagtattttattttgtattggatcatcctgtttgacttatcctagaaaccaatttgctcacttaagtatttatggtcgctcaatacttggaaaattttggatcatcttaactaactcgttattgagtttatcttaatcacggacttgtgtcctaggtcatgagagaaaaaaataacattatcataatcactttatttctcaaccaatttagatactccaaaaagttagtcttgtatttatattagatacttaaattgttgaaacatgatgacataatcacgaaagtgtatgtcttgatatgtaagacatacacaactacatctggtacatggggggacaagaccgagcccatgccagagagtgaggatgaaagatttgtgagagtctcctacgagtcgtccgacggaaaagactttatgaatggagtaaaagaacttgggatcgtcgatcttttccttaaagattgggatgagtcgatgtcgatcgatggtgtgaaaacctcaaatccaaatatatccttttttggatattgtaagtcactcttcattctagaaatcaattttcaaaaacactcttcatgatacccttttcaaagcaccctgctatcatccaaaaagtttttgttagcaaatgtcatttagtcacttttgatatgtatcttcaattatagctatattaggattttgaatgtggaggatagtggaacgaaacatggtgaattggaaaacaattacaattgaaaatggagtttattagtaaaaatgagaaggtgtgaatatcatttctcttgttatattttcttagactatcggggtcgaaaacctttagcatgttttcttcatttatttctcggccttttctttttaggtcattttttcccccaacacagcccccttttttcaattttcaaaatatcaaaattatccttccctttttttgaaataaaaaatcacgcctcttctctcatctcacataccttgtcaattaaaaatgaaaaaaaaaattataaataacctaacaattttgaatttcgtaatatctcaaaatttataaaatgctcttttctaaatagttgataaatctaaaaatgaattttgattttaatgcatacgaaaattcataaaatttattttaaatttcaatcattgacaaaaatatcagaacatataaatgtaaaaaacttaaatcagaacataaaggatagagaaaaatattttttatttgttaaattattcaattttaaattactacaatacacttaaaattaattagttagaataactaaaagagtgattttttgtcctaatttttgttgtagcatgttaatacacaccaactcaaaattacaataaatagagtttttttttaagaggctacaatagatagagttaaaacctttttttttaatgaagatagagtttaaactcaataactataaacagcataaaaatcaaatatgctttttttttaagaaaaaaaatcaaatatttaatacaatattcacaatagacaatgaacccctcaattttacacacacacatatatatatatatatatatcattaaatatttataaaaatctaatttttttacatacttggttttttccctataaactcaagcatattattaataatcgactgcgaaatataatgacgaacataatagataaactttagattagtgcatgacgtagatgctcatgcaagaacataagtcaatacattagcatgtcttttcacaaacttgactctaaagtttgaaaataatgaacggatttgtctaccctcatctaggttgtctccaaattcagaaaaatcaagatgtaagttatgagagagattgtttaaatttaaaaaaaattaaaataaataattttaaaaaatgtaagtttttaataaataaatatgatttgtttcttaaatatttataaaaagtacttttgtctaattagacacagttatttattttaataattttttaaaatattttatttgtcacattagacaaaagttaaggtgtttttttatgaagagcaactaaaactaagttttatataaaatatagagattaaattgaatgatataaaactttgaagaaaaaaaaattcataaaaagtataaagactatttttttattttaaaaaagttcttaatttgtttcccttaaatcattcatcccattcacacagaacttaataaacttttctttagtatagagacatctaaattctataattattacttaaagatagttttatcgacttttttagcccaaaattgtagagcaattgttctttgggaaagaaaacatgtgcagtggaatttaattgagttattgggttgagttggatttttttagtgcaccaaattagattgggttaggtaatggatttataagttttaaattccatcaaatccaaccaaccagactatataaataaatatataataaaaattagtaattatctaatttttttatatgtattgtatgtaagagattatgagtaataaaaagtaaaaagattccaaatcatcactcttgttcactcgcaggccatgatagtttattttgattttggagattgactcaaactaataattgagttgtaaaacaattttagaatactaattgtgaattataaaataatgaagtaatgaatattaattgttatattataatgattaattaagaagcaatgaaaaaatattaggtccggttgaggatggttgtgagtttgccattttcgattttaaaatataatttgaaaactgaaacgtgtttggataaaatggttgccagttgaattttttcttcttttcaaaacagatttcaaattatttcaaaaaataacaaaattaggtttgtggattttagttattgatttatcctaacccctcttccccctcaagtgctctatttctccctctgttgttcatctctcttccgcacagaccaacaaaatctccctctcctccacacagagaccagcaacaccaccactgaactcgcctctgccacctccccaatcctcagcttcaccaccagaacacgcgtagcgccccctgcatccactgtatccccatcttcaccaccattccccaatcctttatccccgcgtcgactcggaaaatccttcatggaacgtacgagcttctgcgcagccttcccgagttcccgtcacaacgaaaatccttcgagtaatttacactccattgtacagaaattacatttaaaatacaaaagtgtgggggaaaattaagcgaactgggtttaaaaaaagactggataaaaagtatttttttttttaaagcctttcaaatttaggcacgaattttttggcttccaacctgagcttaattaatttacattattaatttaataattaagacaaaataaggaaaacatgaaagaatttttttattcgcaacttgtacggaggatttgataataccgagcagttatatttctacataaacttcataataaaaaaactcatacaataaataaatacagtagataagaagaaaagagagagaaaatgacattaattttaagtcttgaccaaaatcaaattgtttaaagaggtcaataacaattataataacacagctttccctaggatgcaaattagtaattagttattctattcctatgctacttttgattcaagtgtaggcattctacttaagtaatcgaattcaggtgtgagctgtcgaaaactcgtctattaattatattcaacggcatcataactctggtagaaattcgtaagagtgtgagactatttcagacggggagaagggatatgggtttctgtgacacagttttatggttgatgtaaactaaacgcgggagattgggttaatttattagaattatgaaaatgactttggtctgatttgactaaatcctctctccccacgccaaaccaagctacgaaagttgactaggataacaagtgtaggctggcagcaattacctgcgaaggagtgagcctctttcccacgttgaactcactgaccctgacccacttcaggggtggatctagaaaataaattaaggggggcactttaaccttgcaaaaaataattttatgttcatagatttagtggcggggagttgcccccaaaattttttttaaaaaaaatttaaatcaatattttatgtacaaggttatgaacccgcttaaaattatattatatatatgtatataactaaaattatttgattaagaaaattcatccataattctatattgaaaaatccaaaataacaattgaatttgataatacaagtaaaatatattaataataaaaaagactgtaaatagcaactacctaaattaaaactcaaaagcttatttcaaaaatgtaatatgaaactgcagaaaaaaaagtgggtacagaaagcaaattagacccaaataagacaaagctagcttctcctattcttcttcttagttggtgtctgcggcactttctttctagtttccatttctgttcttataagttgatttctctttctcttcaacgaaaatttaaggggagacactgcccaatttcaccgctgtttcaccattccaacaggggtattataacttgatcccaaaaatttaagggggccacatgtgacttaatatgtcaatacaacaacaattaataaatcatccttccattaaagttttgccttttactgtaccatacacatttcctataggctcttcaaagctaaattcaattattgaaggcaaagaaaaagagagaagaccaaaggcaggtgtggaaggaagaagaaagctttcatcgaccggtgttcaactttaaacactgaggaagagccacaaaattattctttctgcagggtgcaaggtacagcttcaatgggaaattgctggggttctccacctcacaacccaaccccaataactaccggtaaccttagtacaggttggttgggttgttttgttctttggtctcaattcatttgatttctcatgtgttcatttaatttatgatttcccatgtgcaggtacgacggggacatctcaggcgatcagcagcggcagctatactactactacgactactacttcttctggaagtgggagcagctccataaatagcaagttctcagtgtcaagcggtggtcagccttatccaaatggacagatcttacctacctccaatttgaggatcttcacttttgccgagttgaaggctgcgactagaaatttcagagctgatacagtgcttggggagggaggttttggaaaagtctacaagggttggcttgaagaaaaggccacgtcaaagggtggaagcggaacagtaattgccgtaaaaaaactcaactctgaaagcttacaaggacttgaagagtggcaggtaatccttcataataatcaaaccgcttttactttatttacttctacatatccttttgttacttaatgtactccgctagctatgagcagcccctgtccccagaagaagatattttatgcacaaaaactttttggtagtatcacccttctccagcccagtttcaagcaataatttggaacaagaattagaattttgaaactcaaataataaccgtcgtcgtacccatgcaatttcccttcccttttagttttaggatgaaggcaaagcgtagcagaatgagcatactgcttcttacttggatggcattgactgctttactaaacagaattctaagatctcaaatctggaaatatccccatgtcaccgtgtgggtagcattattcacagaaaaaagcagttgaattgctgaatttagggagtttctgaatagtgtagctggagagtttcatcatgtgtaaattgtgtaatatattatggtattgtaataaaatgaaggcattggtttgtgtccccagccccctcctttcgttttgttacttgtttcatcaaactgttttgtcgtacacttataaattgctattaaactaatggttcattcatttggtgcagtccgaagtaagttttctaggacgtctttctcatcctaatcttgttaagctgttgggatactgtttggaggaatcagagcttcttctggtctatgaattcatgcaaaagggcagtttggaaaaccatctatttggaagtgagtgcttaatgccactgtcttggcaagtgtattataagttcaaacatgaattgaaatagcaaattaaatgtatattttcaactaaaagctacattattttaattgtagggggttctgctgttcaaccacttccttgggatataaggcttaagatagcaattggagcagctcgtggcctcgcattcttgcatacatccgagaaagtaatttacagagacttcaaggcctccaatatattgcttgatggggtgagttctgcacaaaataagcatacacaatatatatttgctgttgccatgctatgagcatgatgaaacaaattaatgttttacttattttctatcttcaacatcagaaatcgttttagtttagtgtgtactattgggtggtcaacttaattaatttctgttatgctacagtcctataacgcaaagatatcagattttggcttggcaaaactgggtccttcagctagtcaaacccatgtgacaacaagggtgatgggcacgtacggctatgcagctcctgaatatgtggccacaggtaatgtcacgctgttctaattgtggtgcatgtgcatatttggtaaaactgatttttttcttgtgttttcaaaactctgtcagtaatttttgaattataagctgttagatacaaaataacccaattgaaacgtgaatttaaagcaagtgatgttattttgtccagctgttttgtcatgttcaagtttttttgtgggggtgctggaaatttaaattgattattagtgtaccttgaaattttgtgtagggcatctttatgtaaagagtgatgtatacgggtttggagttgttttggtggaaatactaacaggcctacgagcacttgataccaatcgtccaagtgggcaacaaaatctaacagagtgggtgaaaccctacctgcttgacagaagaaaattgaagggcattatggattctcgattggaaggaaaatttccatccaaagctgcattccgtatagctcagctttctttgaaatgtcttgcatctgagcccagacatcggccatcaatgaaggacgttttggagaatttggagcgaattcaagctgccaatgagaaacctgtggagcctaaattccgttctactcatgccggacgtcaaggtcaccaggctgtgcaccatcgttctccacgtcaggacggtagtaattagtttctcttaagaaaactaatccctttggttgcttgtgttatttgtctctccgtttaagagtttgcctgttgttcattatgtatttcttggactcacagatttgtacgggtaagtcatgcattactgtattagtattgtaaagtgtaaattattgtgtgttctgctaaacaaatggagaggtctctagtacaacattatcagggaagtgtttgcattaaattcaacgagtctatctagagacaatgtaattgtttacgtatatatggactggtgaaagagagaagagtccagaaacaatgattaattacaaagcagcttcggttttgtacaactaacttcgtaacatattcaagattatagtgtaacggacattttcttctgtgcgcctgttagtttatatcttatctggcattttcttcttgcactccccattttaaattgtgtggacaaaattgcccttaatcccacaagtctcaaccctaaatctacacaaccgacccctccactgtcgcctccgcctcgatagcacgatttctgacgccgatgccgttcctagtgctaacactatcgcaccactgtgactcacccaacaaccaacacaagaaactagcaccgacgagaaagtccgttgtggcgaccatccccatgaagaagcccttcttcttcaataatgtcgatttgcttctacggcttgaggctatggttgtggtccttcttggagaagctcacagaaaaggtgtggcgcaagtgcggcggagaagcaatggggatgagaacagacgtggagtgaaacgatgtcgttgggttttctcttgggagtttgcgaggtagtgatgaaggagaggctgggggtggtgcagcgcagatgaaaggtctattagggtaaaaaggaacaaggatattgccctatttcagaataactattcttaaatataaaaaatacattcaaaaatagatatttcaaaataagttttggagtacttattcatattttggaatgtagtttttttattatttaagattaaaattattctttatgtaagataattttatttgagttgcacacaattattattaaattaaaataattttatgtctattaattttcacacttaatgataataatatatcatatatgataagtctcttaatttattataactatcttaaaaattatactaataataatttttaattagttgatggtgtaaaatttctatagtataaatacatataaattaaattctatcattagagtattgttagagatttttaagagtttaaattttatatattttcagagtaaaaatttgtgcaatcaattaattagaaattattatttcactattaacatagttataataaaataattatattttttggtaaataaataattattttataaagtgatttgtaattaaatgataatataaaaataataaacaatgtatttactcatttttttagttagatgaacgattacataggaattttaagaaaattaaatcaggcttagtaggatttattcaataaaataatagagattaattactcaataaaagtttaacaaatgtatcaaaatatttatcatatatttcaattaagtgggtcccaaaaaaatatgagaaatatatatatatatatatatattataaaataaactttcaatctaaggtataaactttaattgggagtatttatatttaatgcttcataagatcatgtcatgtcatgaaaataagaaatcaagaataatattaatgtacaaatttggacatagaaagatgaataagactaagagaagagaaaaaaataaagagaaatatgtgaatgtgataggaatgagaatgagaaataagaaagaaaaaaagaggaaaaataagttataacatagtaagtaagatgtaattatctcaaaattaattgttttaagagaaaatactaaacaattagcttagtcgttaaaaatggaaatggaaaaatatccgtgggaaaatgttaaattcaggaattaatgtgactgaatttagaaattcaggaaccaatgacgtaagagaaaaatatccgtgggaaatgaaaaaaagtaaaaaaaggttgaataactggccttgtaggttccgtctaaagaggaagacgcaagcatagagttgagttgagttgagttgaggaatgaagtagcgtagcagtgtcatcattcatcatctgatcggcgttgctatggatatcatcttctccgttgcttttctattacaggcaagaactgattcctctcctttctctttctctttctcttaattccctgttgatcggttggttgacttggactatcacactcatttccactgtccatgttgatgtaggtattcctactctcttcttcgcctgctacctcacaacatgaaacctataggtacgtacggctaaatctacattcagattctttttttccgaaccactaataatttctctttagggctaagcattctgaagaatactgcgcaatgtatgatatatgcggtcaaagcagtgataacaaggctctcaattgcccatatggttccccttctgtcaaggtaattcattcatctcttttttactaaactaattaatgccgcaccatcttcatttaactataatcttctaactccagccatcagacctactgtctgccaaaattcaaagtttgtgccccaccataactggaaatgtttgttgcactgcggatcagtttgacacactaagagtccaggttcaacaggcaagttttttaactcggtgattttggttgttgtctgttgcattagctcgctcttaaccatttctagcttatgataaattgctttatctttttcttggccgggggtatcccaaaaacttatctaatatgcaggactagtatagaggagatgagggagaatatatacagtttatgttggactggctattttatgaattttcttttactactctcattaatcacctcattgacatgatgacatattgacctagacccttatcagtattttgtttatttctgtttttattatgcagtaacagaaactttgtatcttgcaggctgtaccaattctagtgggctgtccagcatgcttgaggaattttctgaatcttttttgtgaactttcttgctctcctaatcagagtttattcatcaacgtgacttctatttctgaggtcaggcatttccttctctgaacttgttttttagtaacacttttttttttttttttttttttttttttttactttttaagtttttgggtggctcatttatggttacaggagtgttttctgtgcttctaggtttatatatatatatatatatctttttaaagtaactgtacaactttggcatttgttttcttttagctgcatgttaccctatttgttagtttttatggtttggagatgctgtttttggagttccaggaagtctataatactgaacgatttggggagtaaaatttccagttattcaccagaccagtgttccctttaccccttgtttggttaccatggaaaagagaagaaaggaagagaattgtgtggaaatgtagggtgcatgtgtgtttggttgtctggaaatttttgaatttcagtatgggttccatgccttttatttcttacctaccaaacaacttcaattcaaatatttcctctctattccattgcattccattccctccctttctttcctctcaaccaaacacaccattaatgcaattattttatgtatctgtagcttcattgcaaattatgtagtggttgcttccgagtttataataaagagaaataaagtgaaaataatatatagtctctagagccgataaaaaaaaaaaatctgtaggtaggcttgtatcctcattgcaagcttattcttttcttatgacagtaggttcctctccactggtggatgtttaaaatgaaaaaatacaacaataaagtagctaaataatggtatctattgatgaaatcataaatgaaaactttagttattaggttaaatgctaattgctaattcaggtgtgaaatatgatgattttagtgaacttgcaatattgtttagcttggtattggcaaactgcatatgtttagctatagtttcttaatcatgcctcattgctcctataactaaccaatctttcctcattaaaagagtttagaagaatgtaatgatttgatgctttttgtgtttttatttgttaatgttacatgtttatgataaaaacctttggagaaccacaccacaaaagctaactgttgaagttggagagcccaaagccttataaacccccccctagaatcccatacttccaatgtgagactcaagtcctatatcttgcaattggatcctaacattctaccatgctccgcaacctcaatgcccatgcgggatgttttgcacccataatcatgttagtgttttatgtagacttattgggaaaaatgaaacttagttcaaatatttataaataactagtatgttgagttgtgcactagcacggttgccttgttccttatatatgtaccaaaatggatgacttgtaactatagtaataattttccattgtgctgctggtgtcattttccttcttttttattaagcccaagtagctttcttgttgatataaggtccagttttttttgttatattttatctttagtaggcaacaattggtttgggcacatataaagaagaccactagaagtaccagtgatgagattagattgcatggtttttagcatgtgaaaagggggagaggggagacttagaagaacattggaggaagttgttaagaggaagggatctcaaaagagtgatgagagagagagcgagagagtttagagagagagagcgagagtgcagagaaagcgagagagcgtttagacagggtaacagtagggggggtagaagaggaaacccagacagccaccattacggtgagcttaggtacggagaacttcctgcagcaacggcgacgaaaagaagcacgacggcaagaccaaacaattggagggaacatacagatatctcatctttctattttacgcgctttcctgaggatctgggggagaaggatttgtggttcatcttcaaaaaatggggggatgtgagggaagttttcatcgcaaaaaacaggaataaaagtggcagacgttatggcttcgtgcggttcaaaggtgttgagaatattttgcacctggagagaactctggacaacctcatcatcgggggccttaagctacacgcgaacatccccaaacatgaaagggaggaccgtattagagcaatgaaaggcaagaatgttatgtttgaagaaggcgtaccaggtgcccacgcagggagagatattcatgggccaactcacaatcctcaccttccaaggcaacctgtccagcgggcaacatatgcacaagtggttgccaaacctaaatatgctggtaggaaaaaatggtatccgaagcgccgttacgactttaacaaaccatcctcctcgacgattacgcttgagattcaaatggaaagtaaaaaatggcttaatgaagcatgggttggaaggctgaagaaactgaatatgttcgataggttggaggaggaaataggatgggaaggagaaggggatatcagaccaaggtatattggggaagatatggtacttctgatgggcctaaatgatgctaaagtggaagagatacgccgacacgaagaagtatatggaatggaaagtttccattctctggaaaagtggaatccaaatttgaaacccgccttccgtcttgtatgggtactctgttggggtatacctttacatgcatgggacacgacaactatggccaagctagtgactgcttttggtgaactggtggaagtggatgacgaaactgaggatctccaacgccttgacagagcgcgcttactcatcaagacaccatggaaaccatttattaggcataatattatggctaccataaacggagtcgatttctcgattaacttcgttgaagaatcaaacgcggggacagatacttgccgatgctcaagacggtgtggtgcggacttctccgacgaagttacatccatggacagttctgaggcgggtagtgacttggtcgagttccagtcacatgggtatgtttcaaacaccccgcagcctgcgcctcaaccgcgagaggtcaccccgaccacctcgccgccgacggtggtagcaaccgaggaactcctgggtaacccagacgaggagcggtctgtacactcaaggttgggacagaaccaagcggacagtgctttcggctctgacaactgcaacaacagcaaaaacgctgtcttggtcacatcaactgacaagctgtcacctacccactgtgcacacagtgtggaaaagggaggggagaaggagggatgtcctgaatcagactcgcttttgcggaagccagaagaagttgttgctacaaagaggaaggtcaatacgggaaagctgtcgggagcagcaaatgctggatcagacagccttatgtcagggcaagagagagacccagctatggggaatacatcagataggatggggttggaatcacgtgaggagacaatagtgagagattctctagaggctgaagggggccccactatgggagaaaggatattatcagaagaaaataaaaacaactctttgggccaaaaaagtaatgggcctgaatggcaagtatattccagatgcaggggaggtaaaaacaaggctgttctagttaaaaaccaagctcacgacctggacgctaataataaaaaaaaaaaaaaaagaagaaagttcatctgtgaaagagatggaagctaccaatggacaacaaagcccacttacacccataaaaagccacaaggagagtggtttaaaagggattactgaatgggggggaggatcaaaagaatttgtcactataggatccagctccagctcgacatctataaattcttcaaaacaagttgacttctgggcactagcccaacaatttggggtcaccagccacaacccggaagagttgattcacaagatgaagtcattggaagaaggaatcaatggtgaggcattgaagtggggtttctctgatggggatttatgaagatcttatcatacaacataagggggctggggaggggggtgaagtggaattcaataagaaaaatggtgagcaaacacaatgtggatctgttatgtctacaggaaaccaagaaggagcttattgataaggtgttatgccaagctttatggggagattcaggtgcaacctgggaatcacaatctgcaatcaacaaagcgggaggtttactttgtatttggaatgaggagtcttttaaagtagaaaaaaggctgaaaggcagcggattcatttatctggaaggactatgggtacctgataacaaaaagatcacaattgtcaatatatattcaccttgtgatactttgctgaaaagatccttttgggatgagattaagctgctgaggatgacaaatatgggcggcttatggtgcatcattggtgatttcaataacattcgaagagattcagaaagagtgggagtggcacagagcaaccaggaaggtagaattgttaaggaattcaatgattggattaaggagcttgaagtggaggaagctcccaggattggaagaaaatttacatggtacagaccgaacggaacagcaaaaagcagattggacagggctttggtatccgctgaatggctaacattatggcaggggtgttcacagactactttggaccgcaattactcagatcattgcccaattatgctcacatgttctcatatcgattggggccccaaaccttttcgttttcttgactgctggttacaggacaaatcccttaaaaaggttgttacagaatcttggaattctttagctggaccaggctggggaggctttatactcaaagagaagttaaaactgcttaaacagaatctgaagctgtggaataaacatcagttcggagatattcaacaaaaaatcagaagtgtagaactggaactgaataagcttgagctagaaacagaagacagacaaatgacagcggaggaaattaaaaggcgaaaacaactacaggaagatttgtggatggcagcaaattctaatgcttcgttattgaggcaaaaggcaagatcgagatggatcaaggaaggggactgcaactcccgtttctaccacctgtctgttaattggaagcgacggaaaaacttgctaaatggtgtgtcagttaatggggtttgggtagatgagcctggtagagttaaggaggaggtaaaaaaattcttcaagcataagtatcaagaacctgacttcaatagacccaaattagatgggattcaatttaaatccctggatcagcagcacaatatttctttgacagctccttttgagctgtctgaaattaaagatgctgtatggagttgcggtagtgacaagagcccgggaccggatggattcaatttcaaattcataaaggaattttgggacacactaaagcccgacgtgttccgcttcatggatgaatttcatgccaatgggatttttccaaagggagcaaatgcctcatttatagctttgatccctaagattttggatcctcaaagtttaaatgaatatcggcctatttctttaataggctgcatttacaagattgttgccaaggtacttgctaacagactcaagagggtgatgcctgccattattgacgaacgacaatctggttttattgaaggccggcagctattgcatagtgttgtaattgctaatgaggttgttgaggaggcaaagaggaataataaaagctgcttaatcttcaaggtagactttgaaaaagcgtatgattcggttagttgggatttcctcatgtatatgatgaaaaggatgggtttttgttctaaatggatgtcatggattaaaggctgtttaatttcaacttccatttctatcctcataaatggaagcccgacttcagaatttcagcctcagagaggtctgagacaaggggatcctcttgcccctttcttattcaacattgcagcggaaggcctcactggaatgttgagagaagcccaagcaaagaacttatatgagggttttaaggtgggaaggaatcatgttgatattagcatccttcaatatgcagatgacaccattctctttggggcagccaccaaacaaaatgtgctagctttaaaagtgttgttgctgagtttcgagatcgtgtcgggcttgaagttaaattgcaacaaatgcagtgttggggctttgggcatgaatgaacattgggtttctgctgctgctagtctcctacagtgtgggatgttgtccgtacctttcaactatctgggcattcctataggagcgaatccgaggagggtttcgacatgggagcctatcattataaagtgtgcgagaaaactgtctctatggaaacaaaaatacctatccttcgggggaagggtaaccttaattaaagctgttcttaactcgatccctatattcttcttttcttttttcagggtgccgaaacaaatttctgcgagcttggaaaggctgcagaggaggtttttgtggggtggcagccaggaacagaagaaaatctcgtgggtgagctgggaatctgcatgtctatctaaggaaaaaggagggctgggaattaagaaattagatagttttaatttggctttgctgggaagatggagatgggacctattccatcaatcgggggctttgtgggtaaacatcttggagtcaaaatatggaggttggaggagtcttgacctcacaaggagaacgtcaacagaatctctgtggtggagagacctcagatcgtcattctcatctttggaggcagatggatggttctccaaaggtgttaggtggaaggttggttgtggagataaagtactgttctgggaagacagatggatggaggacaatttatctctaaaagaaaaatatcccaggatatatcagatctctctacaacaaggtcagcctatacagcttatggggtcacccaatcagggaggttgggagtggcactttctatggagaagatctttcatggaaggtgaattaaatacggcgataaaatttctggaggaaatacaaccactgtcagctgctggacagcaactagattcatgggtatgggcgagagatcctagcggaatttactcagtgaagagtgcctacagcttgcttaatttggaggaggccaatcaagacagagatgaagttttcaacatcctgtggaaattgaaaatcccttgcaagatatcgtgctttgtttggagactcatgaaggatagattacctacaaaacaaaatctcagaagaagaaacattgacattgctgataccacatgccctttctgtcgcagctttccagaagatgcttcacacctcttctttagctgccctaaaattctacctttgtggtgggaatctagggtatgggcaaacatcgtaggagtgtattcggatacaccaaaagaacatttcagacagctttctttctgccacctacgtgggaacaatcttaataggtggctctcttggtggtctgcactgacttggcgaatttggttccataggaaccggatcctttttcataacgaactctttaatggttatcaacttatggaagatgctatatttttttggtggtcctggcttaggaacctagagccaggttttgacataccttttcatcaatggtctagtaacttgagggaatgttttgtatcttaggggtaaacttagtcgttttctgttttatccttgttatcgggcagacctacgatggcttctgttttaagccttcttagttctgctttgattccttttgtatacttgtatagcagtacatcttgtactgttttgtttcttaatataatatattatatttttgctgataaaaaaaaaaaaaaaagaggaagggatctcatggtgaataatatccatgaagatatggtcttttatcaagctgaatagtcttgtgtgatccatgtggatgacctcacctaatgggctaagatttttgtgtttatttttatcagtaactaaattggtgaatatagggggaaaaatcaaaacaaattgcattattaataggcaacatcacgttggcccacccaaataatttttgtgaaagaggacaacttacctagcgctacctcccgaagcaaacaaagcaaatgaatgaggtggtttggaaagaaaatcagtgattccaaatcaagcagtagtaatttccgttagaaacccaacaagaactcaatcgttgaatcaactgtacaaaaatatatcaatggttagaataagagatgaaaaataggcaggtaatgttttaaggagcatatgacattatgacgtattatattataggaaatactttgttttagcatgtctctcatgcatcaagccacttttgttctgttttgtttctgctagcttgtacttacagcagtacttcttgtactgtgttgttttcttttcatctatctatatataattatctttgctgataaaaaaaaaatattataggaaatactttgttttattatatagatagaaaaatcagtttttttcatgtgatttagtcttataaattcactctagacttgaaattataatttgatattgaccatattatgttcatttcaggttaatggtaatatgactgtggatggcattgattattacataactgaaacttttggagaaggtctatatgaatcatgtaaggatgtaaagtttgggacaatgaatacaagggccatagattttgttggggctggagctagcaattttaaaggtgattcattataacatgggtggatttattgtatgaaatatatgaactctgttattaagtgatcttaccttttcaattagaacgattcccccttcgtgtattgagtattgatatgttcattgtgcatgttttcctataatttgggatggatcttgagttttgcacaacaataaatgggaaaatggggagttaatttaatgttagcttactccttgtatgtcatttttttttttgatcggcgctccttgtatgtcatgtttgtagttctgaggtagaccgcagatatacatgtttagccataaaaaaatacaaaagatcctcctaagttgctgcagacataccttttcttgttcctattttggtactaagtagctgctaatgtttttcataccattagaatatttctttttctctttatctgcatgtattatacttgctcttcatctgctaatgtgttttgtttttgattgtcattgccagagtggtttgcatttcttggtcagaaagttcctcctggttttcctggttctccgtattctatactttttaagacaaccattcttgactcttctcctatgaaacttatgaatgcatctgtatattcatgtaatgacacttcgctgggctgctcttgtggtgattgtccttcatcacctgtttgctcgggttcagaaccttctccatcaagaaaagatccctgctccattagaattggatctctaaaggttgaaacaatagaggctggttttttctttataattaattttcatttgctttatgactgaataaattctctgttttttctttcttaaaagtaatgccttatgaatcataatctagtggaacaattggttccctactgaaaaactgtctttcagcttttgatacatgtgaaactggttttcgtataatgatacctacaggtcagatgtgtagatttttcaatggccatcttgtacattgtattggttttcgtgttgtttggatgggcattgctgcaaaggacaagaggaaggaggagacttggatccggtgcggaacccttattggatgatatggttggtgaagggagtagttttgctaacctccaaaaggatggaactcatcctgcagaggtatgtttaaaagcttgttttgtattgacccatcgttttggcattcagaaggaagatttcatttcttcttgttattattataattgtggaaaccagctgtcccaaaagctaattgttaggtgaagtcaaatgactgattttataattaaataatctgtgcatatcaattcatgcaagagctctttgggcttgaaacatagataatgttcaggttcgcttgtcttgtgcttaatttcaacttatttatttaaaagaatgggagctgcaagggcgatctctagactacttggtcatatagactttaatactatgtaatgaaccaactatctcatagagatcaaatgttaatcaattaacactaagtataggtcttagaatgtgggttgggcctaactctaccccaaaagctagctcatggggtgagggttgccccccacttatatattctatctttgccttatctctagccattgtgggacttgggtttttcccaataataaggaacctttatttattctcttaaataaatgatattccaaatcaccaaatacataagaccctttccgttagcatttatattatgtgtagtttattttttataataaatagtcatcttttcatacattgtgaagcagctttgcagattgaagtcttttgtattctctgtttgaagaaagtttttaatccctcctcaaggttttggatgtgcaaagcagaataaattgcttaggaaatgtgttcttttgcctggtgtatgctgcttttagttggagtgaaataccttaattttacttgatgttttctttcttcatttttttttctcctgttacatgctccttttctttttataacattttttcaggtttcacctcaccagtcttttgaaggagtttctttgtattattatgcaaagggactgctaacacttctatgctattttttttttatcaatcactccccttgctatagggtgatatctgattctccatctctgtacaacttttctctcatacaacttttctctcataatgaactcttttgagcccctccccccaaaaaacaaaagaaaacattgttttccaaaatccattcctgcttaaacttgaagataatttgaggagagtctgtttttgataactggaattgtatgcatagtagtggttgttgaaccatattttgtattacagtatttttactgcacaggactgctacccttgaatacactgtctaaatttcttagaatctaacataagtaaagtagggactagggagctattttctattgaataagaaattcatttaagatcttggagttctaggaaacactggttatacatggtatgtaaaatgatttggataatgcatctgtaatacaactttgttgtgttttcttctggtttagctgtgggacctgaattaactcctggaatcttgtttctcaatttgcctctttcaattctatattaagatgtgttagagttaaatgatttatttcacatgtataatgagcagttttatttattactcattatgatattgttggctttgtattgtcaaataaaaggtgcaacggatagatcctcaagggcagaatgtggtgcaattttcttttgttcaaggatgcctgtccagcttttacaggtcggtggctctagcagttcttgctaggtttacaattacataatctttgattttgtttatgcattcaggacatatggaaggtgggccgctagaaaacccacaattgttctttgttcctcattgacaattgttgttttgctttgtttgggtctgcttcgttttgaggtggagacccggcctgagaaggtaccatattttcatctatattatctccacagtgtacaatttggatttgcttctgtaacttctacatccattttttttatctccttcctggctatcaaataatatctaccttatcctttttatgctgttactttgttttttttaatctacccttagacatgtttggatgagctgttggaacatatgctcaaatgttaagcacattttgcataatagctcaagcaaattaaaattgttttacactgtgaacctatacttataaataatgtcaagaaaaatattttcataaaggcttatggtaccaaataagtgcttctaaacaaaaaaaaaaatactgtccaagggttcattcttatagcaacaacctttttgtcttcttgagctttctggatagatacataccagtcaatttatgggccttaattcctgaattttagagaattctcaatattctaaatatatataatcatgatttttctgtggaatggtttttgtgtttgttttcttgttcttttacttgctggaggacatttattctctaaatgggtatcttgctctcgctgcctctttaataatatttcttctttaatcctccctctccaacacacaacaaaatgttttctagtacttcaactgcaataagttttaaaaggaacatatatatgctcgtaatccttattttcttcttgaagttgaagaatatcggccttgctgtcttctttgtgttgcagttatgggttggtcccgggagtaaggcagctgaagagaaagagttttttgatagccaccttgctccattctacagaattgaacaggtttcagtttgcttgtaatttattgtacttttctttctggtctcgtaattccatgtgtgtcatctacttactgaaatctaggctccctcttatgtaaatgagttatctagcatgcctgctcatttgcatgtttggcctttaccacctctcttccccacccccacccccccccccccccccccaaacaaaataaataaataaaggaagaaatatattaagatggagagaacaaaattagagtttgaaaaataaggaatcctcaatgaaatgaagctacctaatccctgaacatatctacaagggagatctcccctcccttaaaaagaccatgtgatttatgccaaatagaagccaaatttctgactttttgatccaatgaaacctccttaaagatacgagagatacttgaatgtattttccacacagaaaaatgatctatttacattcaagagtattacaatgacgattaatgccaaagactatttacaagggagcaattaagataccactacttcctaagatacactgaggctgaggtcagaagccttggctgctacagctgacattttgtggattcagactcttcttggtgagcttgcagtccctcacctcactcctatggtgctgtgtgataattcaagtgctctgataaaataaaataaaaagtgctctgataccatcttgataaactgatattattgatatcaaaggagaaattacaattggtcaaagagtctctgtttacactgagatatgtataggcacagagatcctaactaactagtgacagttgctgacaatgtactaaccaactgacagctgtacacagctgtattgactaactaagtatgaatgagataaatatctcagcaaatctcaatagatatgttttgtttatttatcaaataagacattttgattttattattatgttgatattgatgctgatgcaattccaatttccaagaaagttttccgtttctatcgaaaacatgtactttgcggagaatatgaagtcaaccatagtttcctttttaatgtttttgttaagttgccttcttatttcctgctattattttatctgaaataaatcacattttaaaatattgtttgtgtatatttcagctcataatagcgacaatccctgaatctaagcatggcaaaccgccaagtatcataacagaagaaaatattgaattgcttttcgaaatacaggaaaaggtgttttgattttcagtttttttacttactagaatttaaatggagctgttgtatgcttagtggggccttctttattaaaaaatatgtttacatttcaatattccaacaggttgatggaattcgtgcaaattattctggtttgttagtatctctgagtgacatttgcttgaagcctttaggctacgaatgtgccactcaaagcattttgcaggtccaacccactaatttccaaattattcctgtagtacttttgaattgtgtattgcgaataattaattatttggcttctattatctgtaagttgtacaaccagttggcttttcttattcagttctatatcaatttactattctttttttttggcatacttagaagccgtcatttgatttccttttttgtctttattttattctaatagtattttcaaatggaccctgacaattatgacaactacggaggtgttgaacatgctgagtattgttttcaggtaaacttctgtgatctgattatggattaccttagttttgttattcaaacgagtttaatttaaaacagttttactttatgagcagacaaatattgtaaaacaaaaagattaatgtgttaagaaacactaaattccaataagcatactaattcaagttgaaatatttgcataggtatggaaggaatacctgcttttcatttcttttttctttataaatagtgtagctgtagtgtgtcaaatgcattgaatgtagaaagctccgttggtgcttctatacataattacttcttatagattatggtgaatttatctcatagcttgtgtttaataagacttaaatcttattattttattttatcattttcagcattacacttctactgaaacatgctttagtgcatttaaggctccccttgagccaactactgccttgggagggttttctggaaacaattattctgaggtaagaatcttgaattttagcatagatttctttttatgtgttactgctatgctgattcacctattctaggcttctgcatttgttatcacgtaccctgtcaataatgcaattacaaaagttggagatgagaatgggaaggcaatagcttgggaaaaagcattcatccagttagctaaggtatgactactaaatatatttattgcagttattaattcttgtgtagcttatatgcacaaaatcttcattttcattttatttttgacatctctccataaatccttatgttgctgttgttttcttgattattgaaagaaaattggttgtcatctttggtggtatattaaacttagtaattaactgaagaaaccaaggggacattttgttgaggagcattttggcaacttattgtctgataaggatcaaataaccactagattggttattcagtttgacataaacaacccaacgtaagtgtaacaattttgattggttaactattccctacaaacaaggcaccaaactagtgtgactctcccaagaaacaaccttaggatgacctagatgttggagttttgtgtaccaggtctaatctaagcagaagaaatgtggaagtcacggacatgatgtgccctttttgtagaaattacgcggaagatgcctctcatttattcttcagctgtgataaaattatgccgttgtggtgggaatcaagatcttgggtaaacctaattggggctttttctgttgtcccaaaggagcacttccaccaacactctttctgtcaatttaagtcacagaggtggcagatttggtgggttgctttgatttggtgtatctggtatcataggaacaggattatctaccataatgaagtgtttaatggtctaaagctgatggaagactccatttttttttgctagtcgtggctcaaaaatttagagcctggttttgccattcctttttatcattggtctagcaatttgagggactgttttgatgctcaggggagggtcatatctgtataattctaaatttctgttttttggggaggttttgttcctagcagttggtcagaacgctggtgtcttagccaatgctttaagccacctttgttctgagttgcttctgtttaggttgtaatcacattagtactacttgtactgctattatatattttcaataatattattatctttgctgataaaaaaaaaatctaatctgatcaatcaaaagctgaaagatgcctgagagtaagtaattttttttaagaaatagaaataactaaatatattttctgaagaaaagtccctcatcctatgatgaatatctctcgtcccagaaaaaagacctcatttgcctcttcattctttccagagagtaatgccattctctctttttcttacaaaaaatattaacttcattatctcttcctttcatctgtactatcccatcaccacactgctatttcttcttcttcttttggggtcttttcttccctgggtaaaaagcaccttgctttttagggagttagtctttgatagtgttagaagagcaaagggcaagagatactctcacactaatacaactaactcctacttaagttagagcacagatgttattcatacccagcttgttaaatatatttagaaaagccttagtattggcagatatgaaatactggacgagttgtattttgaaatgctacctgattgtttcactctaagaaatttgggcaagatgataaaccaagtgagattttccatttttcacgactataatttaccaaaaaatgaggtaaaaatacctgaccaaactatcttccctgaatgattgcaatgccaagttttttccatgttcttgtaggttgcttctgaagttgaactgttaaagtaaattgtcaatactttcctttgattccactcctgttgcacctcagaaaattctattcttatccatttgcaaacttttaaatgtcctcatcaaacttcccataattcctttctacatactgtaactcacatgcaacagataatctgaacaagcagcacataaaatttcttaccattttatttttcaagagacatatattaatttgggcctcaaactaagcacattagtctgttattggacatgagcacattctctttctaaagcccaagaaaatcactttcccattgacccatttatacatttaaagcacataaagtgtgtttgagtgatttgtttgcaaaattaattttgaatgaaattgattatgtaaaatttattttgaagtgaagtaatttatatatgaatgtttttactttaaaagcaagttagcagtaagcctcatgtataatttttttttttgtatcccatattagtttcctgatcacatggtccataaccctaccatagaatggaagccttatacaactgtaagaatctaagagaatttcagaaaactaaagtgaggtgaaattgttgattgtattcaacccaacagaaagatgattacacctcaatttatatagacagttaaacaactgtaactgttaacttattagactaagaaagttgcagatgaaaaactgtgtgttctcctgtggagaattctgcattaaatagtgctcatacaatttgatttctacatctgtgcattaaatagccaatctgcaataaatgctatcctacagctgggataactaattaaggaggtaattacagcagtataatgatgtaagatttgctgttttgaatggccaacaaatttgtgccaataataacagatattctgcaatttgtgccaattaataactaatattcttctaatcaattccattggcataactaacctgagttagttagtgattgctgtcaaacagctgtcctaacagataactaactaactatagactaactactaactgtagtttagcctttacagatcagtttaagcaaaaagaaaagtggaccgagtaagtatactccaatacttataatgttagatgttagattttgattgttagatgactctaggaaagaaaaacctgaggtctcggtgttagttaccctagcatgttctagtgaagtatgtttctgaatacagatttgtttatttgttactgatatgcatgcctctaaatctggctgtagcctgtaggcaatatattggtataaagtaaatgttgacccatccactgtcaacttttgaaataaggaaaagtgcacgagtgctttcagatacctacttataagtaggtttgagttaaattgattatattgtcctagtacaagtgtctatataatatgcttatttttttgagtgtgtgtacttttgcacgttgcatgatattacagatatgctagctgaatgctagaggtactttatactatctgtcttttcttctcattccttatccatacatattttgaaccaattttacatttggaaggacgaattgctgccaatggtgcaatctagcaatcttaccttgtcattttcaagtgaaagttcaattgaggaagaactaaagagagaaagcactgcagatgtcataacaatacttgtaagaaatttctgtttctttcaactgaatgtgaaaacatgatttgtgttgtgtgtaagctaatggactgattagtttggttgtggcttcataacgatgtgctttattggaatatacaataaatgtcttctccaacatattattaggtgagctatattgtaatgtttgcttatatatcggtgaccttgggagatagaccacctcatccatcttctttcttcctctcgtccaaggtacgttattttccttgaagctttcaattgtccttttcccatgatcccatctagtataccctgtgacactaaattgtttgtgtatattcaaaagtaaaaacttacatgcataatataagtgccaatacgtgctaaattgtacttcttaatgttaatgttcttaactaatgctcatggggattccaagcatctaaactacacagtagagttgaagtgtagaccattaattatgagatgagagaaaaaagaatgagaatagagaaacacattttattttctgaattttacttagcagagtgatctatttataataattgtgattaaaaagataataaataactgctattatcaagagaactacttcctaagataattcaactaagctaaatgcaataactaaactacatggaagaataattatcatttaatgctcctatttccaacattaataataataaatgcaaaggatcacagagttgacgaggaaacaatttgcatgttttgacatttgttatcattgtggtggggtgttagagatgtaatataaagagatgtaatataaaacagccacatgtcttcacctaataacttaagattttgggataattggttcatgacatggtatctgagcatctatgattgagtgatgtagaggttccttgctgccctacttcttctaataaaaagttaaatttcagctaaaggtaggtgagcctctgcatgtgtacactttaatccctaaaggttcttgcataagtaggcatgttagagatgtaatataaaattttcacgttttcatctaataaatttagcttttgcaatagttggtttatgacatggggagtttattttggaatttggatttactagttgatcattgtaaatattctcgtttgctatcatgttgtttgttcaagtatggagacttaggttcatcttaggttgccatttgtttttgacagagtccatagtattttctttaaattttgtgtttatgtagaatattatagagtattagaattagttgtggaatattctagagtattataattagttgtggaatattctagagtattagaataagtggtggaatattctagagtattagaactagttgtatataatgaaccctttgggtttcaatttgaatgaatgaaaaagagtattcacatttcaaaatggtatcaagagcaggttttcctgttatcattgtgcaactctgaagcctattttttttttttttaaaaaaaaggcctaccctcttttggtttgaggtgacttatggactcttctaataatacgagtgaggagtttcgtgcctctcctaattttgatggtgttttcatctccaaggctgggtatgagcaatttcagaaggtgatgcctcaatttgctgaagcaactagttgtgttgctcaacaaggtgttgctcaacaaggtacgacattccatgttaatggtagtaatcgttggattctcgattcagaggcttctaatcatatgacaggtaatgcaaccttgttttgttcttataccccttactattaactgccacgaataagaacagccgatgacagcttctctactattgctggatagggattcattaaactttctgaacacattactttgaactcagtccttcatgttccctctcttacttgtaacctcatctctatcagcaaacttacatctgattaaattgtgttgcgatgttctcggtccatgcttgtgtttttctggaacaggattcgggattgaaaattgacagtgctagagaggaagaagggctttactattttgaaaaggatcctaatgaaacaaatttttttgctcaccactcattatctttgtctgatgattgtaatgatgttttgttgtggcatcgtcggttaggacacccaaatttcttttatcttcagaagttgctcccaaacttatttatcaataaaaaatccagttctttttcttgttatatttgtcagtttgcaaagcatcctcgtgtttcttatcctcctagagttcgtcatgattcttctccatttaccttgattcatagtgatatatagggcccagcccatgagaaaaatatctctggtgctcattggtttattacttttattgatgatcattctagggtatgttgggtatatcttttaaaggataagtctgatgctgcatccacctttaaaaacttccatgctattcaaactcaattccagacctatatcaaaattcttcgaactgacaatggtactgaatattttaattctgttcttggatactatctcaaccaacatggtattctccatcaaagttcttgtcctaacacccctcaacaaaatgggatggttgaaagaaaaaatagacatcttcttgaagttgctcgagctcttttgtttaccatgcatatccctaaatatctatggggggaagctgtcttgcatgcatcatatctcatcaatcggatgccttctcgtgtcccaaattttcattcccctttatcttgtcttaccgacacctttcctttttttggggctcattctttccttcctctcaagttgtttggctgtgtggcttttgtacatgttcctcccattcaaaggtccaagctcgatcctaagtctattcgatgtgctcttcgaaaaggtaccagatcctgtactgctcaccctatttcttatcatatctcgtatgaaaagttatccccaggttttcgtgctttcaacactattttagacaatacaaaaataccaaaaaacatccaagaagcacttgatgacccaaaatggaggaatgcagtttttgaagaaatggatgcactaaaaaaaaatggaacttgggaatctgtagcattacccagaggaaagaaaatagtaggttgcaagtgggtgttcacaataaaatttaatgcagataatagcatcaacaagtataaggcgagattggttgctaagggattcactcagactcatgggatagactattaagagacatttgccccagttgccaaacttaatactattcgagttctactatcatttgctgccaaccttgattggcccttgcaacaattaaatgtaaagaatgtctttttgaatggagatttacatgatgaagtttatatggatccaccatctggttttgaaaaaggagacggttcagtatgcaagttgaagaagtctctctatgggtttaaacaatcccctagagagtggtttgagaagtttacccaagctgtgaagggaagaggattcctccaagctcagactgatcacactctattttataaacactatgatggtggcaaaattactattctcattatttatgttgatgacataattgtcacagaaaatgattgtgaggagataagctctttgaagcagtttagctgactagtttgaactgaaagatcttggagttctcaaatatttccttggcatggaggttgctcgtagtaaggcagaaatttctttaactcagaagaaatatattctagacctgttgcaagaaacaggaatgcttgggtgcaagccatcagagactccaattgatcctaatattaaattgggaattgaagatgggaaagaagttgacatagagcagtaccagaggttggtggggaagttgatctacttatctcacacttggccagatattgcatttgcggttagcatggttagtcaattcatgcattcttctaagtaaaaacaccttagtgcagtttatagaatcctcaagtacttcaaaaacacccctggtcgaggaatgttctttcaaagaggacacaagaggttgattgaaatctatacatatgcaaattgggctggctcggcaatggacagaagatccacttcagggtattgtacctatgtctggggaaatcttgtgaccaggagaagtaagaaacaaacagttgttgccagaagcagtgcacaagcagaattttgggctctagcccatgatatttgtgaaggaatctggttaaaaatacttcttgaggaattgaagatctcttattccctacctgtcagattgtattgtgataataaggctgctgtcagtattgctcaaaatccaattcaccatgatagaactaaacatgtggaggttgatcgtcattttatcaaagaaaaattggaggatggtagtgtatgattgtcatatatacctaccaaagagcagacaacggatattcttaccaaaggattacacaagcccacctttgaggatttgattagcaagttgggtatgattaatatatatctcccaacttgaaggggagtgtagaatattctagagtattaaaaatagttgtggaatattctagagtattagaattagttgtggaatattctagagtattagaataagtggtggaatattctagagtattagaactagttgtatataatgaaccctttgggtttcaatctgaatgaatgaaaaagagtattcacatttcaatagtttctcatggatcttacatcttacttctctcaaactatatcctctctatgatctctctgatttctctcaagatcttaagttcatttgttggtgtcagagctgttttggtttggttccattatgtgagccctcaagggagcttcattatttgtgagagcagttcacttttcaatttgaagattcggtaacaatttactttagtgcctaaagctttaagtttcaaaggggttttctgtttcctgtgtcattagtggtgtaagatgggagacaaaggctgatagtaatattggactattagagtagaagagtagaattcccttttctactctaatatggaccaggtttaagttgttgaccattttttaccataattaatgagaagacctataatgtacattctatcttgaattcttgtgtaggttttcatgcttatcacaactgcattattttttttttttccaattcttttctcatgtggttgatgcagatatgatagaaattaattttaactttttcaaatgttatgggtagcctcttcaactctggctatttactctaatacttctcattcttcaacttgatgttatccaggtattgcttggtcttttgggggttttgctagttatgctttctgtccttggatcagttggatttttcagtgctattggagtaaaatcgacactaatcataatggaagtcataccttttctggttttagctgtaagtctttgtttttatcattaccaagataattttatgaactgccatcagagataccatatttatcttatataagtattatgcaagttgaatggactaagtgcctgtttggttgtattatagacagaagaagaaaatacaaagccactgaaatctcttacaagaacagtatttatactgctgagattcagttatgactgtcaactgactaaggctaacagttaactaactacagtagaaaaactaaggttagttattattatttacacttacaccccccgcaaactcaatggagctgagaaaccaaaggtagctcatctacattgagtttggagctcaaatatgtgaacctagtagaagacaaaggcttggtaagttaatctgcccattggtctgggcctggtatatgctgaaccaccagctgcttagtaagaaccttttttcggacaaaaatcacatccaactccatatgtttaattctagcatggagaactggattatgagctagctgcactgcactggaattgtcacacagcatgataggtgtagaataagggactgcaagttcctggagaagagtctgaatccagagaatatcagctgtggcagcagctaaacttctatattctgcttcagtactggacctagaaaccaccttttgctttcttgatcaccaagacaccaggttaggaccaacaaagacagctgcaccagatgtagatcttctgtcatctgggtctgaagcccagtcaaagtcacaatagcctctaagagaaagatggttattaagagaggcaggatacagaataactccagaatgaagggcacctttaaggtacctcaaaatccttttcacagcagtccagtgagactcaagagaagccataaactgacatactttgttaacagaaaaactgagttcaggacgagtgattttgtaacattttgcaaggctccaacaactgatctgtaaaaggagggatcttgcagtaaatcagagccatgttggagagcctgcagctagagttcataggagaagaaatgggctttgcttctagcatattggttttctgtaacagatctcgaatgtacttggactgagtcatcaaaagtgctccactggataatgaatgaacctcaatccccaaaaaatagtctaaagagcccagctgcttgagagaaaatgaagcattgagttgctgaattaacttttgcatgagtgtaaatgaatttccagtgataataatatcatctacatatactaaaatgtaggtagtggtagaggaagtcttgtaaatgaataaagaagggtcacatttactgtcagtgaacccaaacttcaacaaagtcatagcaacaaaccactttgtatctcagagcttgtttaactgacttggcttcagtatgaacaagaagtaaggaaggatgaattcttggctgcactatgtcagctttggctgttgtaaccataggatgcacattgtctggtctgacatgagcaggttgtggagtattgggagattcagttggagacaactgaagagggtcatcagacagcactgtatcagtatgaacagaggcagaagaagccaaatgggagactgtgcaggatcataaggtcaggagacaacattatcagacctggaagcctcaacagaaggtgaagagtggggagcctcaggagaggatgaggaagaaggattagaattgagcggaggatgagaaactgactcaatgacaggtaaggtggttaaatgaactcagtaggtgtagaactggaagtaggagaggaaaagagagaaggataaggaaactgattttcattgaaaataacatctttggaaatgaaaattcactcaatcactggctaaacactaaacaaaggttgatgagatgtctgtcctacaatataatgccacacaatatttgatttcataaccaccaaataatttcttttgttgagtgtttgcaatgaaagtgggcctcaacgattttgttgatcgtttgaaagctcatttggtggctaaaggctatttccagacttatttccttggttacattgacactttctctttggtggcaaaaaattgcttatgttcttttatttctaaccgtggatgtcatttttgttggcctccttaacaacttgacatcaagaatagctttcttaatggagatttataggaggaagtacacatggaactacccattggttttattgctcagcaggagtttggcctaagtttacatgctttgcaaatttgtatatggtcaaaagcaatgtccttgcacttggtctggatgttttagtattgtattacaagcctttggcatgactagaagtgaagccaattattccatttcctaacaatgccaatctcttggtcaatacatttaacttgtctatatagaggacattatcatcaccaataaatattaggatgatattgaatgctcgaagcagaatttgttcaagccttttcagtttaaggatgttggcaagcttttctctgggtatagaagttgcacaatgtggatttcctagaggaaatatgccttggatattctagaggaggctggcatgaccaagtgtaagcatgtcaatagacccatggctcccagcataaagcttttaccaagatagaggaagccattaccagatcctaaataatattgaagaatgattgggtaactgaactttctcccaataactagttcaaatatttcttttgatgtacatgtgactcgtactaggatgccactgttcaggtcttagatacataaaagagctataggaagatggttactctatgactatgatgatgctgatccggcagattctcctttaggcattcttcctcaagatactgctttcattttggatgtaatctgatatcttgggaaagaagaagctgacatcaagcaatggcagttgcaatgcgtgaactcgtatggctaaaatagtttcttaaggagttaggtgtttgtaaagagcaattcatgaagcttgtgtgtgataatctagcttccctgcataaagcttcaaatccaaggtttcatgaaagaataaaacacatttaggttgattttcattttgtgagggagaagagccatcctggagctgttaacattttcaccaaaattctttgaagtccttgagttaattatgtatgaaacaagcttgttgcatgactcttatgcaacaactttagagcaagtaatataatgttcttagaatttgagtttgggcctaactcaacactaccaatctggcttgtaaggtgagggatgtccaccacttatatactttaatttggtcgtttcactagtcgatgtaggatctccaacacacaccgctcatgccaaggactagacatcttgagcgtgaagtttgcaagactggacatctgcggatgttctgataagtgataacagactaatagcaattggcatgataggcccaacaacaatcgctaagataacaaatgttattataattattagaatgttggaaagtaaacattaagaattgttatatttggttcatgtcctttgagcaatagtgccataggaaatagcttaaattcatttttttttgtcttgtaaatactctcttgatgtatataagtatcatacatgctgactgctaaagataattcagaacctttcttctaaatttgggccattctctacattcaagttttattaatttttataactctcctgccctgcttacttttctgcaagtgtggttagatttcactttttgtttttttggattttcatttttttgatcaggttggtgttgataacatgtgtataatcgtagatgctgtgaaacggcaaccctcaggtttacctgtagaggaacaaataagcaatgcaatgggtgaagttggaccttcaataacactggccagcttatcagagattctagcatttgctgtaggatcatttgtttctatgccagcatgtcgtgttttctccatgattgcaggttacagatttttctcctctcaccctgtactttggacaaaaagaaaactgaatcgacatcatctatacacataaaaaggagggtgaaatatacaactcctttaaaaagtggttttaagatttcttaactcctgaattttcttttttatagctttggcggttctactggacttccttctacagattactgcttttgtagctttggttacattagactttatgagggccaaggataataggattgattgctttccatgcgtgaagttgaatccgccctctgcggagcaaaatgaaggtacatctgagttatggcatgtatacattggttttctgctaagcctgcatcttacagtttaggcttttgggtattagggtttcaaattggtatagcctttatgaccatgttgtcaataagttgatcatttatgctcctattcttatgcatctatgatgggcccttttgctttgtctacgcttcaagcccaaagctcgtttgcatgaggggtttacttggacttataaatcattcttgttactctatctaataagccttaagcttttaggatcgggttggtctttgacatgatatcaaaggctccatgtagtggttataaatttgatccttgttgtccttttttggcttgttgagatttaatttcagcactacgtatgaatgttatgtgatttgtcaatgcttcaacttgaaaggactctcacataatgaaacatcaaacatgttaaggatataaatcactcttaagtctccaccttgtagattaaacacattcacacagtttatatctaacatttccattgaagcataatcatgaattattttcagcttctgtaggtactttgtattttaaactttttctctctccttgcttatatatggttctaatcatatcctaatcaaagtgtaggtgttaggcgggaaagagatggattactgacacgatatatgaaggtaaagttatatttagttcatgagttgattatgtgtaaactaaaaaatgatttttattgtattacccatgttttatgaattcaattttgttgttttctaattttatttggcggtcataggcaaaaaattctcaacataacgccatataacttttacattgttagagtggattagctagataaataggggggaatttggatggaatgggcattcagttagttagaacatttgtaagaaaaagagaaatcatttgtgaaagagaaatcctaaattatttacatatttacaacatagataatatatagtgttagaacttaaatgtaataattttatattcaaaatagataaaacaacttaatcattagtctcgtgaaacaaaattataagttatatgagtatatgaaacctctattttggaagatggaattgaagaaatgaaacaaccaattagagtgcatgcattgaatgagtgagtgacaaatagagtagtggaataatccataagataagctatccttcaattccttttcatttatcaatttaagcttatatgctcttcgatttctttcatgagaattggtgaaagaaaaggaaggataaataatgaacattgactcgtgtgattattgcaccaattcgttaatggataataagattcatattcatttgagattcatcttatgatacaaattgctagctagctgaatcacatgattcaaatcgtgaattgtaatattccaataattatgatagctgccctatcaggactagttagttagttagttagaggggattaatcatataaataagggagaataagattcgaaggggcattcaaagaatttgaagatttgtaagaaaggaattatcctttgtgaaagggaagcagcccttggacaagaattacttttccttgttctgttcagtttcaatccagaaaaattcactctttatttccatcttgtgttcctatcaggctatcacttttctgatcaaaattaactctactatcatcgtgtgaatttaggaggttcatgcaccatttcttggactatggggagttaaaatcttggtcattgccgtatttgctgcatttaccttagcaagcattgtaagtttcttgggaaacgagaaaatattaattttcagtaagacccttttcggaaatgtcattctatttgtgctttaattgtttccttttattttgacaggcattatgcacaaggattgaacctggtcttgagcaacagattgctcttccacgggattcctaccttcaggtttaagtttctatttgttttcccatgttccattttgtactagccagcctcttacattcattttttctttcagggttatttcagtaacatatctgagtaccttagagttggaccacccttatattttgttgtaaaggattacaactacaggttgattaattttattgttcttagcgtacttatctctattaattgatgggtcttttaagaagacaattcaatgttgtgttatttacaaacttaaatgatgcattaggcatgcaagctgctgttgaataaaaaaggaaatagaattagtggaaagaaaattttgtatatcattattttcctccactgtgcttgcacgtgaaaaatctcttatagatgtatcaattaagtgtattatctgaacttttgaacttatttcctgtgagtctcttgtgcagtttggaatccaaacacacaaaccagctatgctccattagccactgtgattcaaattctcttttaaatgaggtaattcaatggtcaagttcttcaacaagtgattattagtgtcaacctccattcattagttctagtaaaaactgaatattttattgattgcttgagagaaaactcagtgaaggaagtgtgtaaatgatagtaaatactggaaacaaagaactctaagactaagagattgactgagattacatcaataatatctaaccaatcttaggaaaaaaatatcaaatacagaaataaaataaatataatccccccaagccgtgtcatatatatgtaattctaggacctcttgaagacttggtaaaatgtcagccagatgatctttggagctcatagaggtattgataatgccaaaaagtatcttctctctataaagtggcaaacaacttatgttgtcttctcgtgaaaaaactagatttaatgagatatagggcagattatcacaaacaagctcctaagaccaaactcttaaaacttgcaagtcttgaagcaagtgttttagccatagaagttcacatgtggggtgagtcatggtgcaatactctacaatctagccacaacattctgcttcttactcttccatgagatgattcctctcataagaacacaatagcctgaaattgaatggaacatttgtcactgacatcttttgcccacttggcatccaagtatagtataatatttgtgacccctagccatataaactaggccctttccttgtcaccccttaatgtaccttagtccaaacaactgcattccaatgacattagttcaagaactggctaataaggctccccctgattaggaagaagcttcatattttggtcgtttgggtatcaaatggtttacaatctagcattcctgttttcttcatgtgtgatcgctgtacccaaattgcaagtgttttgctttattttcctaaaaaattaaggaaactcctcatgaaagtcatatctacaaaaggaaatatctctaaactaaaactaatctaatttttatgggttttccaaaaaaaaatattcttttgtggtttatttttgttcaatttttcctttgaaatcatgcacataaattcataaaaaatgaatttatcatggtgcaaactagctgtgctcacactgaaggtagttttgctcatgaagatggtaagacccttccttgcaacactggtaaatctttgggcctaagagactatagagaagttgtttttcatcagacatgttaaaaaaaacaaaaagggaaaacatattttcaatcacagccaaaaaaaatgagaagatggtgctttctaacagctgcaaaagaggcagtattaggacaaatcaaatcctgaaacataacagggagtggccggtgtcctgttctgtggtggcggtggcaagtggtgtacacacacctgaaatgcatggctactggttgcgtgagtaagggaacatggcagatctgatgagagctaaaactttgggtccccatcagcgacgtccgctttgctggagaaacctgctggaaaaaaaaaaattccagcaatggcagtggtggataatggtagcattttctgggctgtgggcacaatgaaggtgccaaggtgaaaatgaaagctacctaagatagctgcaatgaaggctgcctaagatagctgcaagaaggaagctagtcttttgatgcatcaagagtctgatacctacttgataaacctaaaagatttgaaaaagaaagtggctataagagtatagagtatacttactcttacagtggctgaagtttatttcttattcagcttattacaaaggatgattaccactcctatatatagactacgttacttttaattcaagaatttcaagggactaaaaaaatgtccaacactcaagagtctaagaatcttttttttttatcaccataacattgatgcagagtatccaccagttttactaatgattaatctccgccggagaacctaactgaccacctttagtagggtctcccctcccaaccacatttttttcatccacaaggctcaaacccgagaccttgcttaaggggaccgagcccaggaccactcggacatacgacttgttggtagagtctaagaaactgtacaggctaacttatgaaagaaataaaccctattaattacaataattatattcttcatttatattgttgaatggctgacttgtacataactacacttgtaatgtaatttcatttttatcttggcatatatgaatggattctgtatatattgttctgtaacattgcagatatctagagcatcattagtgccaacatcaagctacatagccaaaccagctgcctcatggcttgatgattttcttgtatggatatcacctgaagcttttagttgctgtcgaaaattcacaaatgattcttattgtccacctgatgatcaggtatgtgcttctttaaatgtccttggataatatttgcatgctgcatgctcaactttccttctctcctatatgttttgaacttatattcatgcacattgtatatgtatatatggtttctcttttctcctgccttgtttttgtatctacatcaattgtataaattataaatctaattaaatattgctcaatgtaccatcgtatatttttcgtttacaatagtaaatgtctgtccttgttcagccgccttgctgtttaccagatgaagggccatgtgggttgggtggagtgtgtaaagactgtacaacagtaatatacttctccctctaaacttttttgtttattacataggacactactttcctaatagatgtgactgtaaatcaaaagggtgaattagtaaagcgactgacacttttggttgattcctagtgtttccgccactcggatttggttaatgatcgtccatctacagcacagttcagagagaagcttccctggtttcttgatgcactgccatcagctgattgtgcaaagggtggtcatggagcttacaccaacagtgtagatctgaatggtttgaaaaatactcactccctctttataaaaagacaaaacttatatttatatttgctgtaacattctcaaaattgaaaatctaatatgtagattttgcttataactggatttcaggttatgagggtggtgtcatccaagcttctgagttccgtacttatcacacaccagttaatagacaagtatgcagtgtgataataagtgatgatcttattttctttgctttggcatatttttttcatacatttctctgtttgttctaatgaaaatcttgttagggtgactatgttaatgcaatacgagctgcaagggacttctcggcaagaatttcttcatctttaaaggtttggacgtcaatggcattatgcatttttactgagttgttttggcattctggatcaaaaaatgttcggaatatagtctacacatattttttctccttgtaattattattttttatttgaactgcatttatgagccttttcctaggattgactctactattactgctattattgttattgtgttatttctgtctttcaccaatctaatattttatttgggagtccttgttttcacttgacctttgagtctcaatctctgttggtattagctcatcactttttatctgactgtctctttgttggtattaagtttataacaaaatattagatgatatgattatggatctacttaccattttctcatccttatgaagcattttgtaatgactaaaatcatacaatgtctcatattgttgattcttttgtggatcaccacttcttgttgattaagtttctcttgtgcagatggatatttttccgtactcagtgttttatatcttctttgaacaatacctggatatatggaagttagccctgatcaacattagcatagcactaggttggtattccaaaacagtttaaataacacatgcacacagtatgagatactcgtttgtcaaccttgttgtataagctggactgtctgttatgatccttcagtttcccttcctgtttgcagtttatatgttgaaatttaagcctttattgagaagatttatacttgtgttcttggcttcaaacttttaaattctatctctatggtctttgatggagtactctgttgtcttatcaacatcaaaccactttatgttttccacttgaaagatatataggatcttctgttgctttttatgtatgaaagatttcagtatcgggatttagactacatattcatgggttgtacttatttgcctccctcttgatatttctgattggaccaaaattggaaagtgaaaatctaattcgtgtcttctcacttttttccatgttttgttttccatttctcggacataaattcttcaactactacttgtgtgaaaatgtatcatatcaagtctgtgtctttctttagtcaaattcgtttgtcattaaataacttatggtgatataacaggtgctatttttgttgtctgtcttatcatcacatccaggtatactgagccttgtatatttacagtcaacttgaaaatttgttctctccagttcaagattaagcataatattctttttctgtttgctattaaatgcagcgtgtggagttcaataatcttattacttgttctgatcatgataattttggatctcatggtaacatttatcttacagttgcaaattcgtttcatctttcatttgctttccctttcaatatcctatttattacctcttagttacagaataaaacaaatgaactttgtgactcctgcagggtgtaatggcaattttgggtattcaactcaatgcggtgtctgttgtaaaccttattatgtcaataggaattgctgtggagttctgtgtgcatatagtacatgctttcatggttagtctgattctctgctctatgaattgacgggtcttcccatatggtacggtggtctttttgaggaaacagtgatatttgtcaatgtgtcactttataattcctataacatgtgaaattcaatctgctttgtcaccagggaaatattgacacactgatttattcagggagaccttttatgcaattgaaccacctgccttttggtgactatgctgtatgcacattttctgatgatcttgtatacatgtgttcacaggtaagcttgggggataggagccaacgagcaaagacagcattgtgtaccatgggggcttccgtattcaggttgactgtatgtatagtggcatttggaaagatcatggattgtaatatttgtagccttaccccacccctccccaccccactatgtgcattatttttggccatatcactggtcagtgggatctttaacaccccctgttacgcagaggactggacatcttgaacatgaagttcaaaggactggacatctatgggtggtccaataacagcccgataaatccaacaacaatcgctaggataggttctcataccattttaaaatttaggtttacactataggctctgttaccatgttagaattgggtttgatgggtggataatatggtaggtgacccaataatggaataaggatagactcttgtaccatcttagaattttgagtttgggcctaattctatctcaaaaccaggttgtaaggtgagggttagtgttaggctacagttctaatgtaaggaaataaatggagtaaataggataataagtctctgcttattctcattcactgaatggtatttaaagataaatacatgcagaggatctgctgtggccaatcagggcccctttgcaatagaaaataacagaattagatgctgaatttgtggatgaggcagtgagaatattcagttgctttgtctttatctgggctggtattacttgtagtcactgaggtgtgttgacctcttgatggtcctcgttggtctgctggtgttctctgtaatagcagcgttgctatcagttagtggattaccccctaattatatacactattttgaccatatcactagagtgacaaaacttgaggacttccggttgacaatgcatacccatatgatgttctaggtgaggaccttgtttgtgttcctgggtggtatatactataaacccagttggaggccacttactcggtggtatgatagttattattttggaaacaagtttataggttgacagggccactaaggtggatgttgccagtgttttgttattgagggaggcactagtttctaagtttttggattagatcacgtaattttcgtatgtatctaaatatgtatttttacatgtatcgtatcctatatgttttaaaataattgaaccacagtaaccaccgtattggatgcgtatcaaatttgtgcatcaacttgtaacataagcataagcttgagggagaatattaaaagatatgaaggttgttagtggtgggcctaggctagggtttgggcttgtactggtagttctaaaactcggtctttttaatggtataaataggtgcatttgtatttgtgtgtgacatcttagtatcaatctcaaaatacattgtttgccatcatttgttctttccccttttcctcgtcttaaccctaaaggttcagcaaagatgaaatgttatgcgcatgattaaaagttcatcttatagtagttatttagtagtgtagctttgatataactcttgatctgttgtcagagaattgatgcaggtataccatttataactaattacaaaaatgatttgaatcgtggttgaattattagtgtctgcctgcactattattttgttgacactttctttttgtattatttatctttgtttggtagtggaatcacacttacaaaattagttggagtcctcgtcctttgcttctcaacatcagaaatttttgtggtatgtgacatatcacccttggctccaaacttgattgtctgctcaagaaatgttaaagtaccttttgggtctttgcaggtgtattacttccagatgtatctggccttggttctcattggcttcttacacggtcttgtgtttctacctgtaagtttgtggtgtttggtgttgctctataaagtataaataactagcttttcattaacgtcaggaaataggttttgcttcgattccattttgcgagttttaattgttggtcacacttggcattcaatttcacaatgtgttcaacaagccttacacgtttgacattgtcattaatccatacaatccccactgggattagttctgccggtaggaatgaaagcactttacctatacggcttatgttcaattcctactgccagcaatcctctttggtggacaatctgttaatatttagcaccactgtaagcccttgctgaggcttgtggtatgttttgaccttatataggacagcctacctttcccctatatgtaacatccctgattttcgatttttcggcgactcacattacggtacttcactcaacatccttgttaatcagaaccctccgtaggtagccatttccaagacctcgaaaatgagttctgtttatttctaagatcaatgactgatcccacaaaccaatacaagatttttcagtgtattttgtcctcattcacatgctttttgggaaatttcccagaaaatcactcatctcattactactccaagtgaagcacgcttaactatgaaattcttaagtgatgggttaccgaaaaatagatgcatcttgttggtatagatagtaccaattaatttttttaagtcatcttcaattgtacagtcacatacctatacagttttcggatctctctttctagtgtgattcgtcgggattctacactatacctttttattcccaaaaaatatacgtgcacaataactaattagaaaacatctcacatttcctgcccttttttttcaggtggttttgagcttgtttggtcctccgttaagatatacagtcattaaggagcagctagaagacatgccttctgcttcatcagaacagcctctaattagatgaaagttagattttaactacgtgatcacatacttaatgaacaagaaaatttgttttgattatagaggattaatattatcttttcgtttgacttttagatcgagaaagttcattgcttatgtatctgaacatggtcacggagaaactctgctgattttttgtaatttctgatgtttggtaggtttgatcatcagttacgttggtgtgtatataattccgagaacatttgctgatatttgaagcaaatatacgtttataaatattcatatacttttgtttctttttaattattattaattggctactgttatcattcttaaacaatgaggataccaccaagaaaatcaacttatataggattgttttactttaatcatgataaaaattacgtgaccaaatttgttatggcgctgttaaattgtctttagtattgatatcactacacgttgaacgaaaaaggaactatatgtggttgctttgaggagaacggtctcattttgatgagatctacattcaactcaagtgtagttcaaattgctaaacaaatatgtatgtcgttccatgaaggccgaacatttgtttgagtggccaaacggtaaaacaaacatacccatgtgttctaacaatcatcaactaacaattcactttccattcagatttctaataaatggctctaacaaagtagtcagtgaagctatttgcaatgtatgacgtgtttcattttttcacctatttttttagtatgcggtataaaatcaaaatatttgaacattcaaataatataaatacatcttattgacatccttcatttatatctatttttctcttttttgtcatactatgttattattattattattatatattcattaaaataacttaactgaaaaataaaactaaatgtttaatataataaattaaatcatatttattggtattttttcaaaaaatatttatagcaaattaattttgtccatctaaaaatttgaaaatttgattttagtccctaaacaaattttatccctcaaaatacaaaatattgttttaagaaaatgtataatttttatcaaatgtttagcacattgatatgattgtcacgggcaaaagaacctaaataatacaaattaaataaaaaattacgcatttggggcggttttgaaactatttacaaatctggggcagtcggaaccgcccagaattgggcagcactggaaccgcccaaatccaggtggtaccaagggggtagaaccgcctggatttgggcggttccagtgctgcccaattctgggcgggaccaattcgtgacacgtgtcagtcctgcacagatggagcgatgcatatataaacttcggacggtcataacttttgactggaatgtccgattgaggcgaaaccggtggtcacgcgttcgaaattgagaggagaaggcgctggcaagtttccgaaggggacttggtcaaaaattttctcaaaaaaggcttctaagtgcctcaaaattgggttttaatcttcgaacatcccaaaattttcttgttttctaatttttaattatttattcagttaattgcatgctattttttatttttttcattacttctatcaatttcaagcatttcgacatatcgtacacctcgatcggacatttctattaaattttttttaattttatatgattttatttaatatattttggattttttgtatatataatttttaatatattattttatttaatataatttctaaatttttatatgatcttgtttgatattttttggattttgtatatataactaatttttaataaaatattttattcaaaaaaaaacttttcaattttatttttgaattcgaaaaaattgaatatttttttatacttctcattttttatatcgagactaaccccattaaacacattattctcatcactctcatcatctctttcatcctctcataatttgataattgtctttcaaaaaaaatagaagacaatttcccttttctctttttgttccagtcaaaagcacgcagtcgattaacccgtcatagaaactacactgaaactcagactttctgtcaatcggtgactcaattgtataaaattagtgtggccaaaacatatacatccaagcgagaaagagaattagaaaggatcgtccatctttcatggtgaatgatcaattgtgtgagtaagttggtcatcatctttatctctctgggtaagcgcaatgcaattctttgcatttcaatttgattcactttgtctcacgcagagccactcctatttctagagttctgcaatgtttccccgctccaagtgcgctttggaattaatggggtgctacaatcccgattattgtgtggtgagtgcactttgggacgaataaataaaaattatattaaatatcaaacaagatcatataaaaatttagaaattatattaaataaaatgatatattaaaaattatatatacaaaaaatccagaatatattaaataaaatcatataaaattaaaaaaatttaatagaaatgtccgatcgaggtgtacgatatgtcgaaatgctcgaaattgatagaagtaatgaaaaaaataaaaaatagcatgcaattaactgaataaataattaaaaaattagaaaacaagaaaattttgggatgttcgaagattaaatcgcaattttgaggcacttagaagccttttttgaggaaatttttttgaccaagtcccctttgggaacttgccagcaccttctcctctcaatttcgaacgcgtggccaccggtttcgcctcaatcggacattccagtcaaaagttatgaccgtccgaagtttatatacgcatcgctccatctgtgcaggactgacacgtgtcacgaattggtcccgcccagaattgggcagcactggaaccgccaaaatccaggcggttctacccccttggtaccgcctgaatttgggcggttccagtgctgcccaattctggacggttctgactgccccagatttgtaaatagtttcaaaaccgccccaaatgcgtaattttttatttaatttgtattatttagattcttttgccgattgtcacgtgtcaaataactttttcatttttatttttaaaaaaatatttttatttttataaaactttgaagtttagttttagcctctataaaatttaaagtttcattttaatcttcataaaattcaaatttttgattttaatcctcataaaatattatattttatttttttaacataacatattaagtaatattaatcaaaaatagcatagtattcataatttaataatattattggtagggtgaaaatgaggactcacaacgtacatactcatctttgttactagcctacctaaaattgtgttaggatcatttatgcgtgaacccaaatctaacatgatgaagaccaaataagatatgtgggataagaataggtcaacttgatttactaacgtaatatattaatattaaatgtataattaaatcgtggattaaaagaactataaagtttaagtaaaatatatttgaaattataaattctttattattgattaaaatttaatctttaacatactttttattattgattaaaatttgttgaaaaatatgaaattatactttaagtgggtctcataaaatcttgtaattttcaataaaatcaaccaataataaagaaggatgtatttaatagagtgcgataagaaaatatattgctagcatctcttaatcaaatatgtcataacgttgaagtttaacgacacactagcaatgattctatggcaatcatgtaaaaattaaattgaattcccttccaaaattttcagtttattgaatcattattctttaagaaatcgagccgcaaacagtttcaagagccgacttaagtcccttccaaccccacatcatttcctttgtattaggagagagaaacaatctaatgcagcgggattactttatttatatgaatataaatttgggttatatatagatatatagttggatggagcaactaatatggagctttgtgaataaagtgtagataaggtaatgttagaatttgaagaacaaattaagtagaagtaatagatataaataaaatgagtctaacaagtaaaagcaaagcagaaattaatgcaaatgtgatggtacagtactaaaaagaaacgcctagggtggaagaaggggtagcggtggtgtggggaaaagtaaatgtatttggtagaatattaagaggagaagcttgaaagagggcgagtctaattgtgcggctctgagatgttgtatgcaagtctttacactcctcaagatcaccatcgcaggctaaaacaacccactccccgtcatcatccaaatactttagaaccacgttgctgccgttgctcacatcgtttaggttgaagcgccttgcgatttccagctgcaattctgtgaacccccaatgtgcttgcaagctaaaacggattttttcatccgcaaaagtagccttcactctcaagggttgttgagggctttgtgctgctactgctgctgctgctgctgctgtaggagaagatgagttgttgttggacttggatgattgagaactcaactccggaaaactgttgtagaatgagccgatctgtatggcaccctcggcaccctgcacggaatcgatcacaagttgaagtttcttcaaagagtggcccaccttcttgattttccttgaaggccacctcgttatgccatgctgtctgcatatccttttcagagttgtgggacacactgcatgcatgcattcattcattcattaaacaagagctagagtagagagagacaaagaattaatgcaattattaatggatcatatctctcaccgccaatgctctttgccgcatcttttaggcttcctgcaaagtactgtcttagaacggccaagctcatagtcttctcggccttggttcgtctcttctcgcctggttttctgccacgcttcccactaaatgtgtgtgtgtgagtgtgagattcttccccaaacacgacctggtcatgtgcctcataagtactggtggcagtactgtcccagttgcagtagtgagttgtggtgactttgaactcctctttgggttcttcttccaaggacacgcacacacctttgtgttgggcctgggcctgggcctccaccatgtgtgcaacccaggaggcctgagatggggattcagtgggcaagaatgcagaaacatgatgatgatcctggatgagagcaagatggaaggtagcgaggcaagcttggtgaaggagaatggataaagagttgaggaagtggttgtggtcaggggagtctcggggaaggaagaactccaagacgaaatgaaaagaggcagtggaagtagttagaggaatagcgacggcggcatgcaagtcaaagagggtggcgtggtgagagagaggatattcggcgttggagaaggcggttatgtcggtggcgaaacagggcttggctgttgcgaaggcagtcccaacaattccttgtccgcggaaaaggtgatgctgagagcaggcctcctggaagcccaagaggtgggggtgcccttcccccacaaagcacgctctctccacagtcgacacgtagttctcatcccttgaatggccgcaggacttggcttgttgctgttggacgcatggagcccatgccagagccaaaggcaccttctgcgccttgcacacacacctcaccacctccatcatctctccaactacctcatcctccatttcaatctggaggacacccaggcatctcccactccctctttccaatacaggaacccccacacatccctcataagggtactcgttgcttctaaagaaccgaagcttcaccttcatgttcctttcaaaagcaatcgaagccgactcatcaggcccaggcccaggcccaggcccatgttcatggcctgtgctcctccgcagtggaacccatatctgaatgttgttgtttgtgtattctctcaagtattccagcgcagcctctagtctgtctttgacggaggaagatggccctggattagcctttggtccaatccaccatgtcttccccatgggcatggcctcgctgctcccactcgtttctacccagcaaccttgtcccagcaactcctcaatcaactcttcttcacactccgaccagctcccaaacgcgccatactccatctccatgcttcctcgatcctatcctatcattttacatttcataaaacacttaattatataagtttaatcacccagaaagaggaggagccatcaagtgctaactcaccttaaacttaagattgcttgatgagaaaatatgattacctcaactcagctcagctccactcgacatgcgaccgatcgacaagcctcttatataatgaccagaaaaggaatggaaactctttctttcttctatttcagtaggacccaccgttaagcaaaaaccagagagtgccccctcagtctcacatctctcaccgtgtccggtatttatttatatatacatatttttcccttgcttatcactgctgtaaattatacaattatatccttcatgtatactatatactatatgctctgcttcctgtattacaaacaacacccagcaaattaaaataaaataagatcaagtcattctcatgatgaaagcaacatatagagatgaattcaagttactgggtatgtttctttgagattatttttttaaaataaaaaagtattttttttacttaaaaagtaataaaattaaatataattttacaagttttcaaggaaaaaattagtttattattttttataagttaaagatatttttcatagaaaaatatattatgtaatatattcttatattataaatttaagccttcacttgaataaaggttttttaagattcatcatgttcgctaaatcacataacttctcctgtattaatttttttttattcctttcaaaatttattacttaaattcatttttaaatttcacataaaatcgaaataaagtttttttaaaaaaaattggacacgtattaaattaatagatatagaaattgtgttttatttgaataattgttttcataattttctttttaatatattttttatctcattaattatgtatttctatctaattggactattccaccaagttgattaatcatatcaagcgtctatgtcttttaaactcaaaacttaaggaattatagtgtctatagttagatacacacagactgggatacaaggtaagggttgaatccttgcatatggctgaatccttaaagagttaaagatgacccagatcaagacaaacaatcattatgccatgaatgcaaagaacttaggaccaattttgctatcctaaaacctttttatcacgtgagtaaggggtcatacacacctatacacttacgtaggagtaatgtgatacccatcactccttgtatatatgtaagtagaaaacgatgacaaaatcataagaaaacacatgatataaataggtgtgatatattctcattatcacactcaagttaagtagaatagatttcattaaggtttcttgattctttttaattggaaaaattttcaaagtgtgttttctaacatgaacactaatataaaataagatatttgttatagtaatgaaaatatattattatagtttattgtaattttctgtctaaatcaatcatagatattttttattagactcaattacattcgagtcaaataggatcacatactataaacaataaaatcatttatttaactatttaacacaattatatatctaatactggaattcatcaagatctcttattaagttgaaataacttcatatcaattaattagtgtgtttggtggtcgcagtttattgtatttaagatacataattttatcacatattgaatataaaataatgacattttttatttaccaatttaaatacttttgttttaaaatttactcaaatataaaatatccgtaaatacatggaaaagtaccttgtttattaactaaagaaaactcaaagcaacgtaccttacttgttataaaaaaaaaaaaaaaaaatgattgacaggagtgttgggggtgctagggatgtctgtctggccattaatgaattgaagtaagctaaagtagcacctctttgtatgtataatatttaatatataattatgcatgaccggctgtataatagtgggagatcattaggatgaagaatctgcactacagtctacagcaccattacttatgaccaaaacaaaaagaatatatagagagaggaccatgcttgtgcgccacatgccaatcctacagcaaaccagagatgcgaaattgcttaaagtggcaccacatcgccgaaacaaatttatgcttcattcaattttacccatacaagtggatcgcaacaatacttaagcttcattcgtcgattcggaattcttagattcttttttaattaaaaaaaaggtcataatatattaattctaacgtccaagttgaggccgcgaaaattgaaaaaagattcttctctgtttcattggtgaattcattgacgtaatatgcatctccaattcctggctggctagctccatcaacatggatgcttgggcccttttttttatataaaaaaacgtaaccttatttctcacactttttaagataaacagaaaatgtaaccttagagagacatttttaatcataaatgatacttaggacatttttcttttttttcctccatcatattaaataatatatttatatttattccttaaatcatttcatagattcaaaataccttaattataaactcgctaggatcaacctatataataatagattaaaacaatatacatgaaataatagattctaactttgtgcgatcattttatatatatatatatatataataaaaaaataaaattgatcagtagcaagcagtgtccattgtaacatgaaagaagaaaaaaaaatctagcatttggaatataatattgagattgtctccacctacgagctgagtactttttgctatagcttgaactgttgacgttgtaaataaattttacatgtataaaaacaataaataaaaatcatatatggagaaggatctataattctgacatgtgtcgtgaaatgggtcaccgtacgaacaagaccagccggacaatagagtttaaattacttttcaaccaacgggatatacaacagggataacttcttagctcgcagtaattcgtaatcgcattctttcaatgttattgcgaaagctacgttttatcgttcaaaaaataataatcagtacgtttttgatagaaaatatgtacagtatttaaatataattcataattaatgttaatttaaatatattttaagtaaatttaattattttaaaattaattatatcagaaataatttttatataaccttaaaaaaaaatcttgtcaaacatattctcgtcatccttacaaattagaactcggttattctttattctgcataaccatatttgcctctgataaggattgaatatcaatttacgattacaaatcaccataaaaaattatagaataaattatacatatttttttgagatttaaacaaattatatatgtttctctttatgtttaattaagaaaattatacatgtcttatttttgtttttaaaatttacccaaatcttcctaaatgtcatttaaatatttgacaataacaagttatatgtattgataattatgacaaaaaaagattcaaatatattttttgtccccataaatataaaaatgttcaaacaattttttttgtttatttttgtcctcacacaacttaaatttgttactttttcgcttagagctaggtttgaatatatacaacctaagtgtatgctatgataaaaagtgttaggtttttaacttttttacatccaaatctacacatatgtcgttgtaaaaagtgttgtatttcaacttttttacattgtgtatacatataagtgatttaaaaaatttgaaaattttaacaccttttacaacaacatacatgtattcgaacctagttccgggggaaaaataacatattcaaattttgtgagtacgaaaaatagataaattgttttgcagtaacgaagtctgaacattttcatattaatgaggacaacaaaaatattttagtcttttttaatcaaaattatcaacgcacatgaattattattgtcaaatatttagacgacatttaagagtttgtgtaggttttataaacagaagaaagacatatgtaatttccttaaatctcatgggaaatatgtgtaagttaaaaaaaacatatataatttccttaaacatgaaaagaaacatgcataatttactcaaaattataataaagaaaaatgaagaatgaaagcaaaccaatttaatattcataatggatatcaattttacttcttctaaatcctaagatacatacatatcatagataaatatgtcaattatgaaattttgtatttcactttttaataattttatatattatgtatttaataaatataattttttaaatcaaaaatacatattaccttgtacaattcgaacaagaatgttgaaatgttttttttccatttttaatatatattgtgttaattttgacatatattaataataagtttaaatatatttttgatccctaatatatgttcaaatttagtgtttgtttcttaaaaaaaaaatatttgcatttgctcctcatacttgaacaattttgatactattagttaaatgatgacatgtccattaaacatttgataagacgatttgtgactactctagaaaccatcataattcatttcaaaatttaaattacaatttctgacaattaaaaattgctaaaatcaatgaaagtaaaaatcaaataatttttttggcaatgactccttcctcggcctaatccatatccctccattcataaaatgggcaactggatcataaaaattacttctgctaccaaatatgctacccatatagattagtatttcactctagcattgttttcatttcaattaatagcgaccaatcaatcatccaaggggaactccataatagacgtaagagaaatacacttagagggaatgtaaaaggttgaacaaccaatttaaatattggatgcaaggtgacaaagcgatgcaatcttcggtggaggatgtcttagatctaggtttcgaggcgaaaaatcatgatcttggcattggactaaacctgagtggtgtcgatggggaggttctacttgatgccgatgattgaacttggacaacggcaacgagatagttttgctcaatgttggagatagtggtaagggagaagccttggcatatgaggttgtttctagagagagatttatttgttgatacaaatctcaagggaacaaaacttgccacactagtaagggaaggtggcctcttttgcatgtgagctttttttattactttaattgattctattggtttttaaaccataccgccaaaagttgtaatttcattctataaataactactgttagttttaaaaacaccacaaattatccttcaaaatagctaatgaacatgtcattacttaacttatggcagagatttaaaataaaatttttcaaatatcagaaagcaaatacgaagaaaaaaattattaaggagcgaatgcaaaattcaagtatatattaaaaattaaaaaacatatttaagccttaataatatatataaaaaattgaataatatttttttatatataacttataccaaagaaaaaatttttttacaaaataaaaggaaatttttagtcctacaatgaattgaaataaatttatccattgaaatattattataaagtataagaatgactaaattaacaatttatcaatcgttgtacttgactcatcactctaactggctagcaaagtttgagtcgaatagtttagaacctttcgcgttttggtcctcttgtaccctagaggcaattagtttgtttagttatgtttttctgtgctttggctttgtatctttttcactgataaaaaaaaaaaaagtacttgactcatcactttttaaatgtcaaccttcaattcatttgttgctaaaagttattttcttttagtggatgtgtgtgtgactaattaatgtgtatttgtgtttattaaatcaatctcaatatttcatcggagttactattgtttacaatatcccgataaattaacataacacaaattttttacaataagagatgtgatacaaatacaaaaattcatataataagttactatacaacatcatttttttctatctttactattttcttatttattaaatttaaaatttaaagtatttctctttatttctgttggttcattgattgtacactttgttgtataattttttatacaattattattttctttaagtaattaaaagtttataataaccagaaaaatcggaggacaaaaattaaacataattatatttacatatagtaattaaaacatattttaacttttttcttaaattttcttttcaccctaatatgtttaaatataattttgatttaatataattagttataatattaataatcaattgttgacgcaatcaattattaaaagaatttatttttaactaagactaagaaagcttagcctactttttgtcgaggtgggtcattgttaatgcgcttacgcatgtacagtaattactaattagtgaacggagcaaagaaatcccttttaacaaataggtcggcccacgaatcttcttctttcaatttctgatgaattaaaaataatataaaaatttgtatgataaagagaaggaaaaatatatttgaaaaatgaattgagaactagtgcaacaggaatacagcacattaagaacacacacaaaaataataataataaaatacagtattaacgcattgaaattaaagtatatgtgcgtagagccaacctagcctacaatcgaataaaattgaactgatattagttctcactaactttgagcaatttagttcttgtactttaaaagaacagtgatttttatcattcgttacaaatactataaaaagagacaaaatctactgctttttgtaaaacttaggatcaagttgaccaagttaaaaattcaaggacaatacagaaattaaaaatatattttacctaaaatttaattatagttacagagtttaaaagattgagccgcttcttcattttggcgagaaacaaaaatagtttgtcataaactggatgtactttactaacacgtgtatcatagataacataatatataagtttagtattattttttgtttaaaaataatctcactttaagacttatctatgcgaataagaagttattaaatattttaattttaaaatataaaattgctctattatattagaaagaaaatgcaaattaaccctttaaaaaaagtctttatattttgaaaatatgcaatatatcttctccattaaatttttccttagaaatgaataggttttgtagattcgcacgtgactcgatttattccaaaattatttataggaaaatataaattactatcttgaaatttgaataatatatgatttaggatttgtttgttttatattaaagaaaatgtacttattgtgatagatttaaaacttagtgagtttgagtaaaagtattgatacactatttagtataattacaaaaatatttgccatttatgtaattaagcaaattttgttggctttttcattatttctataggaagattgattccaatccggattgatatttgtgatcttgtatgaatacattaatccttagttttgggacatactattaaattatattaattatttaaataaatattaaatatttttttactacctcctcatatgcatatttacctttttatcacaaaataatttatgttttagaaatacaatctaatatttttttttcttcaaatatatccttatttcacgttaataaccgtaaatgcgtgatagattaaagtattaaataaagatattttagtctaaaatacaataatattttacattcattaaatatttattaactccatttggatgacaataaaataagtattaaaaaaacatctatcgattataattaaatagaaaagtgtcattcaaccaattttacttttaaaagtgttagtattattatatagtaaacggaaagcataaccttatattagtcgaaattcgtaagagtatttaataatataataatcataatgattgatgtttgatattgatggaggaaagagggtggatattactgtatactgttgatacttgatactccaatatattcttgacacgtaattgaattcccaaagttggtgtctttctgtttacactcacaaatcacaaccaaaaataactaaacaatgaataatttcgtgcgaatcactttcttgaattgcgataaagtttaatgcaaggctgacttatatgctttgtttgcttcagagaataaaaaataataattaaagtaatgtgtttggacgataaataagaattaattttggttcataaaattatgataaacatggtgaaaaagttaaagaaactattaattacttcactattattgtgattttttaataattacgttagaagtgaatttaaaccaaacatgctattagaagtataattcaggaaattacgataagggtaagttcaaacaaaaacaagtatttctgctgttccaaaataagtttggaatatggagaaaaaaattattctaaaataagtattatattatctttttaatgtaatcttaattatttttattaatatttctaataaatactattttaatttttcatttaatatttataataaaattaattttataaaattaatatactatttcatttatcttttaatttttataaaataatctaaaataacacttattttacaagtctaattcctagactactgtaggaaaaaataaaatcaatttataacgaaagttatgattagcacgtcatttcataggctttttttaaaaactttttttgtcgatttaaaaatttatttgatcttattattaatgtttgataaataaattattttaaaagtctacaatttttttttttaacttgcaagtaatacttttttaaaatattaatgtctaacttttagttttcatattaattatttcgttgttcttaaaatatttaataatatttttttattcttttctgtatataaggtaaaacttttgcactcataagataggttttatcttttatctttttacgtaatatatgattttcttatttttatctttttattacgtacatattgataatgatagataatgagttaatttattttattattaatattttgatatttttatattacactattttaatcattatactaattacaatatttgttttattatttttgcatcatacttcctgatattactagatgataaatttattttttattttatttttgaaataattttgatattatactatttattttaatcattatattatttataatatttttctattaaattttaacttcaaaatattttaactattaaactaattaatataacaaaaacatgatgtatattgaaataacgtatacaattttaaatttattttacatttgatagaaaatattttaagatatataattacattagatgaatataaaatatgcaatataaaaaaatacactccattctatctcaattataagaaaaaataaaataaaactattctcatatttattaagaaaattagttaatttttttaaaaaaattaagaaaactagttaaatttattaagttatgtcaatcacaattaaaaataaacctttttttcttctaaactacctttattgaaacttgatatgaaacatttaagactaagatacactgatatttttttttcttatatttgagactagatagagtaataattaaaagtaattgataaataaattacaagagtttaaaattaaaaaattataaggacctcaaaatatatttttaataacaaaagtaaaatttatataaaaatacaatgcaaacatgtgtatttatgtcattttatattcaacacttacttcaataaataattttatcaaatgcttataaattaataagttaccataacaattttcactttcaagcttttaatattaacttttagttagtttttaactttcagtttttagcttttttatttttatttttatttttagctaatcttgcaaaacatagtagacatatctaatttttttttaaaatcataaaaaataaaacctcaataattattataaaaataaattaatttactatatataacaatttataattaaataataatataaaatatttacactatcaaattaaaagatgaaaaaaggaaaattttaaaatttgggaaaacaaaactagtaagattttttaatgagaataattacctaagaccaagttaaaaataaagtgagaactaatctaattgatcaagtcaaacaaaaaaaatcatttttaataagtagtaaattaatttataatttttttctatatttaaataaaaatatttcagtaagaaaattaaaaaatattaatctttttaaatatcaacaaaatatacaacaaaatgttcgttgtcttttctctctattttttttcattcttacacactacagtataacttctcttgaatgtacgcatgatccgtatccaagttttctgattagattattatatttgtatacctaatttttgtttcatatcattttcatttcgctttttttttctttttcattatattccttatccaaactattaatttttctattttgtttaattttctctttaatttttttctttcacccataactttttcctatttttatcagaacataataatcaacattaataatatttttaatctaaactaattgaagtccataataataataataataataatggaccacatggtatacgtttaatgatgatattctttttacgattgacacgtccacttgcatctttcaatgatttgacatgtaacctatcgtttttcttcactgacgttagaacccagtcagatgctgtggattacaactgaaatttagacacccaacccacttgttttcctcttctggtaattttcacattatttaattggataaatactattttaattcatattgctaacaaattatttttttgaaaaatataaaatttaaattttattttcaaatatacaaaaagtacatattaatcctgttattaacataagtctgttaactttaacattcctatatagtatatacatgacacttttcaatgaaaacgtatacatgtttcttgctatatcaatgaacagtcagggagctattttgtcagaactaatgttttccatactactcattggttaatatagaagtaagcttgaattttccgatacatataatgtcaaaatatgcctcataatctcatcaaaaatataattatgaatgaaattaatgcgaatctaatgcttagaatcggtacttgaacttgacacaacataacattttttttaatagagagggcaacacaaccattttataatacacttaaaacattaacactatgtaggatattatatataattattttttatcctttactttttttaaaaaatttttttataaacatgcatcttaaaataaaatgacaaccttttattataacacctcttaaaacgttttccttttcaatatgttacttctctgatgagatatttcttttaacatctactgaccataaaactaaataaattaactttaacatctttctatttctttcccaatcctttcttctattttttttaccaagaaatacatgactatggtctccgtatataatatatgtccatgtggaaaagcaagaaaattaaaataatggcaagtttattgtagatcgactggaaggtgcttacgaggttccttgggatcttctccttgagttgtttttcctcgagttccaaattccctcgtagcgaaatagagagattaggctctagaaactatagatttgacattaacacaattttagtttagtatttaaatacttttgattgcaatggaacatgtctgatcaacaggaaaccaaattaaactaaatttgagcatgccggcaatcagtttcaaggggatctgcttaattaagtaatataagtatgcatggttacgagataggcaatcgtaaggctttagattctcgcattaaatcatagatacagtttcgctatgtatgttatggatttccatatcttatagggatcttatcaacaattatcttttattctctctatcttattgtttgatatatagtctttttcattagctataacagtagaatagtagcctctggccaacccataaactaacatacgccgttgattcaaaccaatttttccaaatcccgttattatttaatattagatgtttgctttaatcgcttcttcagttatcatcttcgacggcattaattaataaagggtgctgctgtatatgaaataatcgagcccagtctatacatgctttggtcaagaaacaattttatgtgagactcatttctatagtctataatttaaataaaaactgatgaagttctactaatttattatatgcataatgcatgatttaatggcaccaccctgaaataaatatattctaccaataagggaagccccacttctattatcttttctttggatttttggaaactttcaataatcttttttataaaaaaagttcaaataatttaagcttggatattactagcttgttcatgcgcaaaaaaaaatgatctcagttgtattagttattaagcaactcatatttcgtcaagtaattaagatcttgaacctgaaatttgaatcaatggcatttttcttttcctctgtttttttaattgagttgaaagtcaaacaatatttattcaatttctctcaaatatctgaatgacactttttaaatgcaaatgtcattgttctttaattttcccatatatatagaaattttaatgggtcccgcgatggatattaatgaatccgtattgcatctgcattagatatctgatcctttgtaattgtattttattagtgagaagaaatcctgctctacgtgattgatttcatttgtattttttcccttctttaattactttttaatcttttttccttaattaattgaaaaatccatcatattatgagggacgtaagatgaagcgggtagaatatttacaacaattaaatacatttgaagcagatctatattatcaaatcaaacgctcaagtttataccttcaaaaccaaggaattccttgggctatagattcgaaacgatctattcatgatatcgtatccttcattgcttcagtgcttcagtttatatatatatatatgataataaataaacggacaaaatgaaataacttcattgcttcagctttttatatgatgtcctcaagtcttttagctaggttgatgaaagtgaccacactgatactgatctagcatggaagcaaggttgaatacttggaaagacacacaacatttaagttagtatgtatatcaacaacatgacaatatatggaatacaatgtttatctagtgatattaaaaatactttatttataattctcggatgcaggtgagttataataataatgccattcgagctcatcagccatctgataatcctaatagagagtgagtccttttaacaaaaatatcatgaaacacctgacgtacgtgaagtatgtgaacaagtgatgaggatactttgcttttgaacatataattataaaatgcactatgtggtgcatgtaggctttgaatagtgtattaggccttaaatttgtctcccgagtcccggccctataagggatttgagtggttagaactatcctgggtttgatcatactgaatttggcctaatagtgtaaacctcaaacaagagtccaccaaacttggcatgctgataaggaaacgtgacaaacttgtcatctaggatctttaagtagcatctgaacctctagtaaagaactcttgttgctttgacaatcgaattagttcaatcatgttaaaatttgaacctttgttaatcatggtgtagtaataaacctttgttcatctgagcatcggtgttataatgatttgagttaccttttcaattgttgggtgacagttaatgctagttgggcatgtaggacactgttattggtgtccaacccttgagttttaattcaggctggcttcactatgacgcatatttaagagttgttttattcgttatatatatatatatatatatatatatatatatatatatatatgcaacaactaatgacactgatgaaaatattaataagtcccaatcttgtatttgctttgaaaaagggctatttaatttgcagtttttttgttgcactttaatctttcaaatttcaaattctttcagaatttttaattttcttcggtttccctcttttgttcacagtacttcttccattctcaagagaccaggcttgcctccaagagcgtttctcttcattattcatttgttcaacaaacgttcaagacttcgatcatcttcgtaaagtttcacattttatgatacaaagtctatcttccttgtctggcctatgtgctctccctagttcttttttcttactttatttaatttttctctattaatagtaaactcacggtatgcatatgactagatatccctagaggtgtggtaaattgaatccttggcgagtgagggaaaagtctaggggctagcttcaagtgactttgattaacttcaattttgcagtccttgaccaacatatataatcacgtttgcaaccagtcattcatatatatccttttactattaatactttaatttacatgtatgattatgtccttgtgacacttagtcctttacgaaggttgttgatcagtgagtcacgggggtggaccgtggacgcccactttatcattgtttttgcacctattccaaactcaaacgttctctagtcataagtagagatgggtgactctacattaatgtaactaccaaatgtcaacattgataatgtatgactaacttgacttttaatgatttgtaatgtacttctttaatttacgaaaggtttgtaatgtaattatgatcatgtgtaagtttttgttgcttcatattgcttatgaagacagatagaaagagacatgcatagagtgaaagtgagatgaaagaaagagttgacgtgtgttgaccattttttttttacattggattgattttgcattaaaaaaaatgaaaccaaataaagttattgttttattatttagatatttttataatgaaatgaaaaaaaaatcattccattcccttcaaattaagatggaagaaaaagaagaaataataaatgaaatggagcaaaatgcatttttatcatatttcttttaatttattttaaacaaattaaataatgaaacttaattgttgtttttattttttaattccattatatactcgtatttcacccttaatgtgaatccaaatatagtctgaattgcacttgtgaaaataagatgcagaatgataggaataattcacagttgaatagaatacctttaatacgaaactaagtaatgtgagatttcgccaggcaatagaaaataataggctcgtacgttccatccatccattgatccattcgaaaagtctactgttagtttcccctaaactactacgaatggtcgtttatgctgggcatgcacattttttgatcttttaaaatatactcttagagaagctgtccaacttcatttcatcttccacttgggagataagcataccaacttctcaggtatccattaaatattatatgaaacttgaacataaatgacgatggtacaatacaaactacaaaggttacatccacatatcttgaattgataattattgttaatgttctagttattaggagattcatatttgtaagtactacgaaggagacgcacaaggttttaaaatagtcgcagttggagtttcattattgcaagaaaatggagctgaaatgactgcaattgtaattggcatgtggtcacaatgagtaaaaagagacttaacaaatgcctttaaaatcatggatagagatataaatgtttataaatagaaaatgaagatggtgtgttgtgaaggataaataataggagagaatgaagccgacatgctatttgttaagaaagaaagaattagagtggaaaagtataagtgtccttgcatgctaaaatgtagagagaatgaatagatcgatgcgattattgcataaattggaaaagtaggtagaggtaaggaaatgagagaagttagggataaagggggagagcaaagagagtgtagtctagagtgggaacctcaaatcgagagtgaggacagagagagaattggaagatgatgagtcccagtgacagcgcttgttgcaactcgctttggcgttggagttggagttggagttggcaagctggagcagacaggcagcgacctcgtggtcttcctggctcatttgttgttgtctcctcaccacattgggcggaggattgatccctctccagtgacgctccgggtggcatctcatgtggccgaagagtgccttccaagaccagaacttcttgccgcactccgtgcagggtcgtgcctctgactctgaccataatgatgtcttccccttccaccctcctgcatcctccattaaccgcttccgcttctgcttcttccgggaacaatcagactccctcttcattcctcaattcaatcaaagccttttccaatggaaccgcatttccttatgtacctgcctcacggttactactgcaactcctctggcggtttcttcttttcaactttttttttttttttaattcttttctattccctatttccatagttcatttcaatcatttcttttaactaacttgtcatttcactattttttttaatcttttttcatttcatattatttaattatatatttttttcatctattaaggttacataaatataatattttcaatagaaatctttaaatattaattaaaatttaatatcaaaatatgtatatgtttcattagtaatacattttaattttatttatattagcaatattattatcaaaatgaacattaaattctcattatcatgtgtgtgtatggtttactaatagagacaatgtctagtacaacatgaggtggtttttttatatttaatttataagctttcaatagagatatttcgttggatgtaatgatatttatttttaaagaaaaacaactacaaagatgtgaagcttgagtgttaaaagttaattaaactaataatcatcaaagtttaaaagcgactattatatgatgttttgaaatataaataaatcaaataggttttacaaaaaagattgtattaatttgtttgaattgatttaagtataataaataaatttaaaactttctcataaaatgaattaattacttaatttaattaattgcgatttaagtaatcatagtatacaagactatatacttgagttcaattgaaactattgattatttttatgtattatatttataacatttaatttaaatattataataacttcttaaatgacttagtattataatgttcaaaaagctcataatgctctagaacgagcattattccatcatgattttgaaggtcatcatggattctccacaatcactcctaagttcttggtaagaatgaagggccaaaccttaaagttaacagtccaagattatcctcctctaagaatatacacctaggacaatgcccaacatagacaaggcacaatttttgctcgaatggaataatacctgtttcattctattttaatccaacatattctatcccattatgtttcaattcattttgtttcattctttatcatcaatctaaacatcattatctaataaaagtgtgtgaaagaagacatcactaagaaagcagggaatgtgggctgaggctcgtggtccaactgcttagactgagcccgcacggactacgattctaaaaaccaattttggaccacagaatggctcattaccctgcaggccatgcagacacaggacaaacttttggaccatttaatttgcaggccagcccgtatattcaatcgagaattacacagaatctcccataatgggacgtgtaagtgataatgattatttgctatcggatgtcatgttattcctgattgaaattgtatttgctaaataatctataaagtaataaatggaatagggagcaaaacgaatttagatccctgttcctaaaaaaatgactggggaggtgtttgtattttgaaatgaaatcatataggggtctgacatctcaaatgactgccctgagctctccagtaagcagtgcatgtttgcggtgctgggacaagattggtgccacctgaactgcagtcagtattgatgctaagtcattatatgtgggttccttgtgttcattagctgcatgcagaattgtttgcaagatttgcaagggatctccatggctgacaaccaaaactgcacatctgcaagatgtggaaccgaattatattagctgatagaatatgaataaaaagaacaaaataagaacatctcaatcaaccactggtggaagacctactaggtacctgtttgttttgccgttagaaaatcaatttttgcactttccaataatgtatggttgggattactttcgatacacattccaattacgttttaaaagttcaaaatcaatttactcaacttgaaaacaaaactacgatgcagggcttgcacacattcatgctgaaaaatcaaagaataccaaaagactttacccttgaaattctgattccatagtggccattgcagttgcaagtcgacaagcaacatccttgacactttcccctccttctggcccaagaaatggatctttttcatctatatcccaaatctcttggtactgttgaagattggaaagaagtaatcaatgagttgcaaactacagttggtgtgagaatagtgacaacgatagagtttattagaacctgaacctgactaatgttccaaacatacaagatctctatgacaaaaaaagatgcagagaaagagattttattttattaaaaattaaggtgaattggcaaaacagtaggcagcagaacaaagtgggcattgagcatgacttactttatcatgcgagaggagttcaaaagaaggaccaaaatagcgttctcgaagatcttggatgacctgcttagtgcttagtaaatgagactcgattgagggataaataaagaggcaagttgttggaagggcttaccttacagtggggtccatcaaaagggagattcaagagagttgcaacaacgttagcggtatgggttgttcttgaaaagggggagtagcaaatgcgtacgttagcaagcgggatattattggcctctagttcctgcgcagcgcagtcagggtggcgtggttaattgaaattgaaaattgagttgaggtaccttttggaatgattgtgcagcgagttgggcctgatgaacaccgtcggaggccaattggaattcggggagagtcccattctcctgccaatgcgattcaattcaataactaagaaaataatattattagattggacttgatttaatttaagagaaagcaaaccatggaggaaacgatgatgcctcgctcgttgggaatgctcttgccatgcctcagaacccagtatctgttcttcacaatccacgacatttgatttgatcccttaccctaacctaatcccctccctgtgtggcataagaattcctgttttactttataaaacaaaatgagagatcccttttatttaaaaaatatctagagaggggcatgagtgcaaattgcagagagaacctttggtttttgtttatcattagtcaattcgtctcctttcctttcttttctgagccgaggctgctgtgtgtgtgtgtgtgagagagagagagagatgggggtaagaagtaaattaagaatgtcagcgtcagtggtgcagcaggggatgaaggaaataagaaggagcgtgacgtacatgcctcgaccgggggacggaacgccgcggggggtgacgctgataccgggggacggaattgggcctctggtgactcaggcggtggagcaggtgatggaggcgatgcacgcccccatatacttcgagaagtacgaggtgcacggggacatgaggcgtgttccggaggaggtgctggattcaatacggaagaacaaggtgtgcttgaagggtggtttgaggactccggtgggtgggggtgtgagctccctcaacgttcagctcagaaaggacctcgatctctacgcttccctcgtcaattgcttcaacttgcccggcttgcccacccgccaccacaacgtcgacatcgtcgtcattcgcgagaacaccgagggtgagtactccggtctcgagcacgaggtcgttccaggcgtcgtcgagagcctcaaggttatgtccaagttctgctccgaacgtattgccaaatatgccttcgagtatgcatacttaaacaacaggaagcaagtcaccgccgtccataaagccaacatcatgaaactcgcagatggtctcttccttgaatcttgccgccaagtagcaaccaaataccctggtatcaagtacaacgagattattgtcgataattgctgcatgcaacttgtctccaaaccagagcagttcgatgttatggttagttagtttaattggttactatagattcatcttcccttccctttccaatctaaatctcttctcgtgttattatctcaggtgactcctaatctttatggaaatctagtggctaatacggcagctggaattgccggtggcactggtgtcatgcccggaggtaattgaatacaaatgcaataataatcgttcattctattgaataggaagtaaataaatggttggtgcactgcagggaacgttggggctgatcatgctgtgtttgagcaaggtgcttcggctggaaatgtcggaaaggaaaagatggtggagcagaagaaggcaaatcctgttgctctgcttctctcctccgccatgatgctcaggcatcttcagtttccttcattcgccgaccgccttgagactgctgtcaagcgtgtcatttcggagggcaactccagaactaaagatcttggtggagacagcactacacaccaagttgttgacgctgtcattgccaatctcgactagactacaccttcccatggctatgcacaatctttttcaaatatcctccgccagttttttgtaatcaaagttcattttctattgctatttttcagcagggttgaaggctcaccctataataattcggcttaattttcatgtaattatgtttgctcaaccaaagtcacttgtaacctgtccattgtttgaggtcaatttgctcaaacaaaggatgcttctctatccacataatctgtaatgtaatgttgattgaaacgaacaacactgccttccaccccctccgcttttcacgtaggaacctttttttgttggaaacatgctatcacctcaaagtgcaaggaaggagaaaagtaggaaagaattaataccgtaaaaaaccaaacactgacatgacttagaggtaatttcaattgagtttcaaattcataggctgatatatatatatatatatgatacaaattcttttctgcaggtgatcctctagtccggacaagtatgcttaaaacgaaactagaataaatgtgattagatagtgaaaattatgcaattaaggtcgtgtgtatttatctatataatatttgactaaattaaaccattttcctttacaaagtaacattgactaatttcattgagagaacccagaaagtgcttctaaaatgtcttaaattatctacacatctaaatataatatccaacggagagaatcctcttcaaaatgtcacatccagtgttgcatccatattctccatctaaagactcacgagaccacctgcaaacatgagttacaagatcaagataacaaatctcgtagatatgaatatcccatccagaatgttaagagcaatatcacataataatattaatcaacacagaaaaataaattagaaattattttcctcaatatctgctttaagtgattaagcatgccctagttcaccaataaactaacaagaagcaaaattaactcttcataaatgggcacactgccatgatcatgctgactaatattatctttgctctttctagtgacattgtcaaacaggacactaggctatcagcatcaacatacacattccgacttacaggtaacatcattttcaatcagattaaaagtcaccttgaaacttcagaaaatgagtattaaccaaggatcacagaaggtatacaacaaggccttatcccattagttaggtcagctgcatagatcaaacaaagccaatgtactcaatgagttggagcaaggtctttttgaatggtttcaccaaagatctttctttacctcccttaattgaactatgctcatttgatttacatgatcaaacgaccttagttaagtttctatcatctcttcaggtgctactcctactttatgtccactaatccaccataacattcctcttttcgcaacattagctcttgttagcccatcattgagcggcattagtcttatagttttctggtcacattgtaatcacaaatcatgcctaaagcatttctccatttcatctgaccatcttcaaccctatatgtatacccttcaaactctgcaataaatttctcatcactttgtaagatagatccaataatcttgaaccatgctttccacctccaaaacattactagcttgcttacaccttctactagcatctaatatactccatcaaggaagatttttttctagaaataaccttttactgtttggtgcacaaaatatagcagctgagtagataagcaaaaccaaggacagaaaggtaaaaataataatattattttcacaagtcgagagaaaataaaccccagcaatgatgttaactatactttactcaatcaaaaagcagagacatgataggaattgtaaaatagaaactgacctccgcaatttgtaaatctgtgtgtagaaaccaccaaggaccattctttgagagtaatctgaaaatgtagaagcacaaaggattcaaccacaaaaggggaaaaaaaatttaaaagcacaacctggcaattcaaaaagggaaccacactatctagcatcagcaaatctactgaaaggacagggtgatacactcaattactatatttctttctcttaataagcttggtggagggttagacatggtgttatccctatgttccagatggtcactttttagtcattttcttcatcatatccccctttcttctttcccccttctttgcttttactttttttttcaacctcctcgtatctatcattgggttcatctaccaccgacttcaattagtttgggttaaaggtgttgttaatgttcatgtaatgaacgctttacaatttcactagaagatttgataacccatgtagaagatgtcaactatagacacagattttcaaaaagcactttaacaattgaaacaaggttaaaaccatggcacttatacaccattccataaagaaactataatagtatagtatgatcagtcatgcatacttctatcatataaataccatcagatcaaatgaattgtcagcccaagatgtataggaaaatattctaatcaaagatggataaatagtagagggtgaaggttgaagtagccatctagtcaaatacaatgggtagagtaacctatttttattttaaaacaagatagaaacaacatgaaacatttcttcccaatacacacaaaattaatgtgccattttacctgacagcaccagctgccgcacgaagagccatgaagagaactaagcccagccatacgccctgaaggccaaaaagtggaggtgcaaataccaagaatgcagaggagactgctcccacgaacatctatgaagcaattgtcataaaagttaacctcaagaagcatatgtaccagaagagaaaaatgtgacacatttagaaaagtaaacaacttaccatggagaaagcagcatatcggaaatcagaaacaccataatggagaccatcaaaaatatatgccagtgcattaaatggttgagaagcactgacaaactagcaacaatcacagataacaatgtaattttgatgcagacacagacaaatgcaaacaaatacatacaaatcaatcagcaataccatacataccaatgccagagttctgaccacctgcaagacttcagagtcctgagtaaaaatggtggctaaagatccaaacgatgcacccagaattgcagtcaagcaaatacccattaccagtccaatctggaaaggcatgatcaggttctcaaataatttcatataacttccttatttgacatagtaaaacaactatagcttacataaaatctaagaataactaatgaatgaaaggcatcaaaggctaaaaattcaatccattaaaaaaaaaaaaaagcgcttacccttaatacaaaactagtaacttccttcacaactttgtattcatgtctggatacagaacttgcaataagggcctataaataataatatagcagtataagcaaaaaggcatatacaaacaagaagacagtaacgaagtaaaggccaagcttaaaagaatctatgaatttaaaatgttaaaaagtttcaaagtcaagcaaactgaaaattttcccaagaggttcaaacaatgcacccagaattatgtctggcttttgttggctcgacttgtttcattgcaagacagcatggtatttttactagattgaaagaaatttaggaaattataccacaagggggaaaaattaaaaagataaaatgataaagaaaaatatacaagtttttgtaatggatgattcaatacctgaccagatgcagccaatgcatctgtcagaagggaaacagccaaccacacttgcatacatatctgatgtgcagccatagctactggaccatgtcgagcagctattgatgtccccaatgtcatggttgaaagaacagcaagtgttcttccaagaaggaaaccacctgtaacagcccacagatcataactgaaacatctacaataacctaacagaaagctaaataatatacacagtaaagaaaagagaaatgtgtccatgcaattaaagttaaacatacataaattaataatctctctaaaacaataatttttctggtcccaacttgggccagcttacaaaattagtaatgtgtccattccaaacacacacttgttctcttaatgctaattcctttaaatagaaatattacaaacaacaaggggaaaaaaaatggaggtgagatcttttgcttggaaagtgttttgtaaacagtgtttgagattgcatttagcttttagttgttatcttcccttctccctactttttcaacaaagagaaaatcattttaagaggatggccaaacacactctttcatctcaggttttaacaacacataataagaaagacacaaatcctcaccagatttaatataattgccaaattgcaggtctcccatctttggaggtagtaactcagctcgcttattcagacaccagatcatcaacatggtcccaatatatctgaggtacaaaaattccatcataattagggttgaatcaagtaaagaaataaagaaaaaagtaatgcttttgaaaaggacttactgagagatgactgtggaaatggccgcaccagttacacccagccgaaagtaatacataagtaagggacataagaagacagctgaaaagttaccaatgcctgcattttgaaagaggaattagcacacacatacatacaatataatgaaaatgaaaatgatttttaaatttaatcaatctttgaaagaaagtaaaagagggcaatccctagtgtaatgttaaaattatgccttggtgacagctggtcatgggctcaaatccgaaagcaatctctttccatatgcaatgggaagactgagtacaattaaccttcccccatacctttgggaaatgaggagcactgtggtatgttagtttttttatttttaaaaagaaagtaaaacagcaagaacatttatgatatcaaaatctaaaattatttttcaagattataaatcacaagtagagggcgagtcctggcacagcgataaagttgtgccttggtgacttgttgatcatcgatttgaatctggaaacagcatctttgcatatgcaagggtaagactgcgtacaatatccctcccctttaccttcgcatagcaaggagcctcttggcaatgggatatgtaatttagttataagtcacaagtattccaatcaactaaaaatatcaattccctctcactcttcagcaaacatgctatgataattttgttcattccttagagttgcatgcgagctagttaataataacaataatgtattcatgaattgcgagtaaaggtattagagtacatgcagaaaataaaatagaaaaggtattgaaaaggagaaattaagaaagaaagcaaacacttgccgagacatataacaggagtttttgtatccttaaaaccgcggaaaatgccttgaagagccaaagaaagtacaaccgcaggagcgccaacagctcttaaagagagaaagtgtcgtgcgggaacatatgttggattttgctgttgaaaaaggagaagacaaatgatatactcggaagaggatacaagaaataaaacgcataaaggagagggcgaaaacatactgtaggaacaccaattaaatggagaaaagctccagctcccaggtataaagctaaagcctcaaaaaagccaagggagagtgccaatagcaaagcagtggagacagaggagagttgttgttttgttttggcatctgcagtggaggaagccttggcaatgtcctcggcaacaaaggaagtagcaacacttagaagggggatattaaaaagcttagaaatgatgttaaagatggatatggaaacgccggcagaagccaattcaacagtgccaagtcgaccaatgtaggcggtttccatcaactgtgctaaggggtcaattgcctgactggcaagggcggggagagtaagagatataagctctcgtttgacatccacagaagcagaatctgaatggtgttggtcctgagaagtgaaggaagagggtttagcgccaagtgctatgaacggagcggagaggctggggctttggcgcaggaagtggtggtggtggtggtggtggccataaccgtaactgatatggttgcgcttgcgcaggaagggtcttctggggaaggctccatgatattgatattgaagttggtattgagaggtggtgaaatggatagcctccatgagcatcaccgcctgcactgcaagaaagaaaaaagttcaataatccatcaacatcgaaataaatatcaaataattaggcagactcgactccacctgcagcccacagaacgtatcgtcgccaactaaccttttcctctccctctgcaatacaaatagatagctgtctccgcttcgctcacgttcagctctttctagatgaaattttaaagcactatggattaaattattcaggtaagggatggtcataaaataaataaacaaaaattaatattttgactattcatttggaaattactagttaaatgttattgatttgactaacttacaagttaatccgactaaaataaacttataaatatttttagcttatttttagaaattagaatatatatatatatatataattataaccaaataatcaaatatatcgttttattttatattgttttatatttattgactaggttataatttttagcaattctaaccattgaaagggagggagtatgcagtgattttagatgcggagcctccaaaccagattaaacagatgttggccctttaatgttttaggagtttcttccacatttagttttaatgtaattttctttttctgggtttaggctccgctaattattaaaaaaaacactttctaatcaatcagattaacttatatatcaatatcaaaagtataaaataattttacattatcatctgataaaataataaaatatatgataaatttattaaattttataaaattatcttaaaaataaatattttttatctagcttcaagtgaacattagaaaccaaaaatagtaattcaatttttttaggacagaaatcaaaatcaaaatacttttcagagatcaaaattaacatttttttaagacacagaatatatttgtattgcaaaaagagggattaaagctgtaaagacattgtaaaattagacccaaggacaacagggggattagtacagaagaagaaaatgcctggttttactccccttctatacaaaacccattgccacgctgaggattttatccggcaaagctaacattcattcatgttacttgggatcaagaataatgatttcaatgaaaaataaaaaaaccatttttcttttaaaaaaaatcaaaatcaaaaacttgttcatttaaaaaaaatgtcacttttaatttattacatttttcttttttaaaaaaacaaaatcaaaacttgttcatttaaaaaaaaataatgtcacttttaatttattacatttcacagttatttcattctaaaacattaagttttaaaattttcaaaatatatcatattttaaattttttgttagaaatatttctgttttgttaatttttaaattttaaaatgatttaatgtcacttttaatctattatattctgacagttgtttcgctttggtacattatattttaaaaattttattatgattatttatgtttttaaaatgtgttgttttgatcattttttggtacattatttttgttagaagcgttatggtccaatattttaaattttataatagttaagttagcatagtggtaactaaaaatcatcattattttttatatttaaaaattaaaaatcactcaataaatgaagaaaatatgaatttgaaatcacaaacaacaacaacattcactctattattattattattattattattatattattattattattattattattattatcttcattcaatttaatcatttaataatgataataatttcattcactaatcattctaaattacaatgggtaagggtcccttctcctttcgcctatcgcccctaacccaaaaagatcgttgccccgcccccgcttatgtcttcgccgcaacctccctacgtagccataattgttgcctcacctaacaacaacaattgtctcatcgccgcactgacaacaacgcattgacgaaagcgaagaaaaagaccaacaatgcctcatagtggatgaggtttgaccgatcggaccagtcataatcatcttccaatgaaatgcactatttaaccgctctttgtgctactcgtttttgtctttcccagttgtaaatgttgaatgggaaattctatatttattcggtctaatcgtgcacctaatcgtgcacgacagtggagatcttgctcgcaaaccttacaaagagtcacattatgacttcctcgttcatatctgaattaattggcgagataaggtcatatttttgtctttcgttgaagacactttttgctctgatctcccctgcctttgtttccaatagcatagctgatgaaatgttttgattttcctgtaaagagtataagaattttttgtggttctagggagattatgtgttgacgtcgttcaatctgtgtgatgccgaatattttaccttttcaaatttggaagaggttggaggagttgaaattttttagttgtttagttatttttaaataaaataaagataatgactatttttagtcgctactatgtaaagttaattattttaaaagacttaatgtctcttttggtatattatgttttgcatttttttcacttcgatacattaagttttaaaagttttattttggtcctttatattttttaactatatcattttggtctttttttaaaattaaaagttaacataacactaacgtcgaaaaattgaaaaaaaaaaaaaagagaccaaaaagatacatttaaaaaatgagcataatgaaatttttaaaacttaatgtataaaaaaaaaacaactttaaaacataatggaaaaaatgattaagtctttaaaaagcctgaaatgtttctttcatacattattaatttgataatgcaccctttcaaaataaatttgataattcacccattaactaattgaaatattaaagtatgattctagatactctcaaacattaccttatcttagatcaatattaaaatgaaaaatgctactcagactctcctaaactctctttttaacactactaaaataatatcttcatcaacatacaataaatccgggaaagcctcaaggctccaatagattaagaagaactaataacttgagtaaaattttgtaagaccaatttgatcattttcacatttcactcgtcactatttccatcaattacatctattttgatagatagcttgtgcttcaactcctctctacatttacgaataaactttctccaattttggtttcgtaaccgtaacatagaggaatgaaacgcgagagcgagatcatgcaccacatgaaacacacgtgaagagtagtaaagagcaaccaaattttttgatgggattgcataaataagtactaataaagttaaggtgcagaaagaagaatttgtgccttaaatgttcatcaatcaatgtatgtcgttgttacttgttggcagtgcccacgtatccattaagaaatcacttttctctttccctttgattttcaatcgtaatattacacaaggaaataacagttatcagaaaattagaattcttagtacatgtttaagaatttttttttaaataattatttttcaaaagttattttagaaacatggttaaaaaaaataactttttctttgaaataaactcaagtaaaagcataattttaaaaatttattagttttatctacctgtttattttagtaaaatattttattcaattgtaaatacaatcaataaaaatggcctgtagaaggaacttgtgttaatataatcggagtaaaaaaataaataattagaatgagatacatacatgttatatgtttttcacatcccaatactcaacaaacacactgtttctaatcacctcttattgataatgatcttaaaactaatttatgtaatgtaaatagtgaaagaaaacaaagtggtaagtcgtaatgaaagctataacagagttgtgagtaagaatttgctccaacccaaaagcagaatatatataacagtagtaagtacagcttgaatataacagactttgagttccatatataggtagagaatccgctggttaattagttagagtcaagcatccaagaaacttgccatgcactccatatttagagtttagagatggaattgattgtaaacatttgagtcaaaatcaaacttggacagcgaaaccaagtactcaacgttaaatacaagattaacgcgagcttaattgaaattttggtttggtgagaaagtaaaatttacgaggggattagttggagttggaacttagaagttagatgactcattgacacgattgggttaattagatacgtatatattgttgtatatgcattgtatttgatcgatcattcaattccgcgcacaggtatatcgattttacgtgcggttgcgttcgtttctgttgaaaggtcgtcgtctcttctccaccttcttcaaagaaaaggtgacaaaatggaaaatgcgagaaacggtgtcgttgctgcgaatgcgcttcctcttcttccatgcaatcaatagcattaagcaacgcaatattgatcgaattaatgaaattcggcctaaggtacgtaacgacagcaacagcaatgaagagaaagaagcatcacactgagaaatccagaataatcggactcctggttgtgagtttccttcgaagtcggctcctccaccgcactctcatcatcgccatctccgcatcccttcttctgctcttcgccctattctctctgttcgctccgtccccgctaaatgaaatcaatcttcagactcagaacaatgaccaagttagatcacgattcgaggttccggtaagctattaagtagtaactaaaacgcaattgtcactattctgcattttattttgcttaatctatttgtgttggttggactttgaaggcgggtggaggtagatgcaggcgtgatttatggcgttcaatgcactcacgcctcttctatggctgcagtaatgccggtgtcaattttgcaagtaaagctaatcccaatcatctcatctcgcaaccaatttatgaatttaatttcggactttaaattgaaccaaattgtaagccgtgtgttcattcgttttttattggacgtgcaatttgattgcgtaagtacttgtttcttgcacttgcagatgctaatgtcaaaacgaatccagatcgatacttgctgattgccaccagtggaggtttaaatcaacagagaacaggggtaagcttcttcatcaactaataactatctattatcagctcatatgcaatacctatggtttcaaggaggtaaccaaacaatattggaagatttacctagtctttctgtatgtaaccaacatggatggttcttttctttctttatctgaaatatgtcatatgctattgctctaaattcaattgatatgatatgagagttttgtctggcggggctatcagacaccaatataatatgtgatttagggatacaaatttaagtgacatgaagaaggctaatttctgtggctggattattggtgcagataattgatgctgtggtggctgcatatcttttgaatgctactcttgttgttccagagttggatcatacatctttctggaaagacaccaggtctgtctttgccttgtaaatcatgtatgatatttttattggaagcaatattcatggtctcttaatttgtgtgctatttttttgcagcaacttttctgaactatttgatacagactggtttataacatttctccggaatgacgtgagaattgtaaaagagcttccggatatgagagggaacttcgtggctccatatacggtgcgtgttccaaggaaatgcacccccaagtgctatgaggatcgtgttttacccgtgctggtcaggaagcgtgtaagtcttcacatcctcaaaattatttgcctgcattccaccattaaaatctggacttttcctcccctgttttgagcctagatgctgcatgcctttctgttttttttttggtttattttatctatttcttttatagaacttaatcttgccaaatttataactccttaaatgcactcagtagtataaatatttcaaattgctagttttgggtaattttttctcttacgaactgaaatcttttgttattttttggcatataaatagttcaggggggaaaatattcctattcttttccattctgttgtatatgaatatcaaagcctcaacgcattttttttattatcaactatagtgcacgtttggttatatattaatattaacaactaatttccttatttttataaaaaaaaaaatcaggaaggtgaaaataaatatttgtttcttaaaataatctaattcaaacatgcggactttactagtgaaagttgcgttaattttacggttgagcaaaaatagttaattttactaacaagtatcttgtactttctatagattatttttaaatatattaaaatttaaatttatttaaaattataaatatacataatttattaaaaatattataattaaaatttaaaagaatagaagttaagaatagagtgtactaaaagattaatgcacttttaagtcggagttttctaaatgaatatgtatgaatgaatttacttgaaaatatatgacatttgatatgaataatgtgagtagagcttttaatcataaaaaatcgataatcgatttttttagtagaacatttgatatttgattaaacatataaataaggaacaataaactaaatgaagaatttatggaacattgattaatcaaaattgaaatttatttaagcaataatgacggttgactctcaaggaaaatacaataaggaaattatcttaagtagtgactggtgagtctgtaaaaaaagtagtgacacgtagtagtgtcttggaaatattatttaaaaaacaaaaaatcttcgaagctatcatatactgtgacaattgctaatcttcaactattgtaataagtacgttatggtggtgttcttgattcgatggatgatacttgaattccttgatgcatgcaggctgttcggttaactaagtttgattatagacttgctaatatgttggatgaagatcttcaaaggctgaggtgcagggttaattaccatgctctcaaatttacggattccattcaggggatgggtaaattgttggttgagcggatgaaaatgaaaggcaagcatttcattgctctacatttgaggtaattaagctttaataattatagccaagctttatttctggttcatttagttcctcagcaaagaatgcaatatgcagcatgatatcaacgtcagaatttcatcagcttctttaagttataaaattaactcgcattttgtaattgagacgctaagttcttttcatttttcatatagaagttcaatgtgattcaaactgatgttttatcacataggtttgaaccggatatgcttgcattctctggttgctattatggcgggggagaaaaagaaaaaaaagaacttggtgaaattaggaaaagatggaaaaatttacatgtaaggttttttttattaattacatgtaaaggttttagtagcatctaagaaatgagctccacatgtacgaaaattgattgatatattctctcttatttggaaatgggagacaggcaagtaatcctgagaaagttcgaagacatggaagatgcccacttaccccagaggaagttggtcttatgctaagagcactaggttttggaagtgaagttaacttgtacgtggcatctggtgaaatatatggaggccaggaaacgttagcccccctgaaggctcttttcccaaactttcattcaaaggagaccatagctaccaaggaggagttggcgccatttgtgtcattttcttctcgcatggctgcactagacttcatagtttgtgacgagagtgatgtatttgtaacaaacaacaacggtaacatggccaaaattttagcaggaagaaggaggtacttgggtcataaagccaccatcaggccaaatgcaaagaagttgaacctgttattcatgaacagaaataataggacgtgggaggaatttgcctctcgagtacgaacattccaggtaggctttatgggagaaccaaatgagttgagacccgggagtggtgagtttaccgagaacccatcagcttgcatatgtaaaaactctggtggtgggggaatttcctacccccaaaatcacaacagtattaccgagtttgaagagcagcaggagtggtctgaggtagcagataataagctcaatgccaatggaactaaaattgattcactccctcttctaatgaccacggaccaattagctgaagtgcaagaattcttctccgattaactctgttatctccccaatgatttcatggaccgacggtattgaatttgtacatatatattcagcttgggaaaaaatgtagactgtaagtagcaattgtatagagtttgaagcttctagaaggaagactcgttaaggcgttcgtttgctttgatcatagtgttaactgttcaggatagcagaatcgtcagtgttccataccattttagatatttttaaagatttagttgtacatgtccaaaaaatgaaatttacaattcaaaaactcttttttgtctttaacttgttttttcttgtgtggctttggtgcctcgcacccggagaaaacttgagttttattgtgtgtggttttctaaacgcacttggagaaaactaccggactatccacccttctggatttgaattgactctgtggcccagtacttgcatgaaccattcgtcttgctttgcctttctcatgggctttatcatagccttttattataccttcacttgattagtaaatttgtcttttttttcgattggtttaattaaggagcactttgaaaagccatatttacggcaatttctactttgacgagaatgtaaatttttttactaacaatatatgaaaattagactcttatttttataccatcattttaattaaaaatacatttcccttgaaaaaatatgttggtgatgtaaataaacaaaaattcaagattgtaagactcaaaaacatgttaaattgttttaaaaaaagaaaaaaaaaagaaagcaagaaaaaacaattaaaatctttttaattgtttttaaaaaattgatattaaattactgatatatccttattacaagtgaagagatgatggattcttttttccaaagatttacggtataagttgctaatgtactcatacttaaatacttagtgtgagtgcattagcaaactcctatacatatgtgataatttttaaatattaaaaatatttaatgtttttcatttaaccaaataaaattttattgtaaaaaattaaaaatattcttttaaaaaagctgaacgaaaaaatttatcctttacatgatagagaatctcaaacaaacaaagcattaatgtttaccgcagccacatattatggtattgatcccatttatttaaacttattttttaccagagtgtttttattgataaaaaagtttttttttgctttttttaaaataaattatatatacttcttaaaaaattattttttttaaatttaaacaattgacttattattaagtaattattgctatttttgtgctatttttgtgttctttttggtaataagaaaaatgttatgcataatcatccgttgttagtggtgtaattttttttattgacaaatgttattggttaattttattaaaacgttaatgaaaaagatttgtctatcatggcgtggcatttcatagctgaaagaatgccttcttacagtttaatctgtgaactgaaaaaaatacatttcttcttctttcaccatgttgtataattaaaccaacaaatagtttcctacttttctcccactaattatttttcctaggagactttgtatgagtgtttggctctacttaataaccactaccaaaaactgacaccaatcatgaaacccatcaatggacaatgacaatcctttgaaaggtgacgacaagtcctttcaagttgggaccattagcgtaactatgaagcgctttggtgttgccatttgcaatccaatcttattggctccaacaccgcgaaattatcaaaaggattaattattttttaaatttatcaaataagaataaattttaaattaatactagggaaaaactataacatctttaatagtataccttaaacaaaatcttgaattcaagattttctctatatctccaattaaaagaggtgaagagatctctaacacatgaagaattaattcttataaaataactcttacaatattcacattgtttaaaaaagaataagtttttccttgttctttctctctccttaaaatctcaaaataagatctatcaaataaaaaattagaaatatattaaaagatcttcaatcctatatagttcgatgggaactatagaaaagtgatcgattctaatttgagatataccattaaaaatgttcttactacttctaaaatcaaaatcataaattaattcaaaatttttatttttctattttttactaaaacataaaaaataacaacttctgatttttttaattaagactttaaagtcataaatattttaaattttttaaataacatttagaagtcacatatatatttacgacttcaaaatcatacttttttaaaaaataattattaataatttttaattatttttaatttttaatttatagttcaatatttttaatcaatatatttaatatttttgttactaatattaacaaataattttaacttaaaatttatcacataatattaaattgtttttaaatttttaaattaatttttaactttatcattaaataaattaataatttcatacagtattattaaataattttatttgataaaattattttaatattaacaatagaaaatattttaataataaaaataattgttaaaataaaaataacataatacattaatataaaatgaacaatacaaactaaatacaagcataaaattaaaaagtacaaacaatattagtcatcaacttacttgtatagatacttattataattatgtctttgagttctaaacaatgagtttttcttaggcttatttgaaattgatttgttcatcttattatatatatgattaatgattgacattcacaatgtgtctagtcgctttgaatgatcaaatataaaatataaacttaaatattgaggtaatttaaatttatctttacttccactttaatattttttatttaaatttaactctttcgtttacattattttttaaatttataaaataaataataatccttaaaattagtaaaaaatataaaaaatattaaaacaaatagtatataaaaatatagaaaatattaaataaaaaataatatataaaaatatagaaaatattaaataaaataatatacagatatagaaaaaggtattacttgaagttgtaaataaatatgtttatgacttctaaatagtatttaaaaaattaaaatatttactacttcaaaattgtaattaaaaaaattaaaagtcatttatttttttatgatttcaataataaaaaaattgtgaattaatttatgaatttggttttaaaaattgtagaataccatgcaacttacccctttgtgaatattaatttaaaatttatcctcatttaataaattccataaataattgcccctttgttaatttcggcccccagcccccaaactcccttacaatcaaattgtactcagtagttacattaaattatgaattaacacatattctaataaataaagtgcatttatgattaatagttggcttttttatattataaaaaaattatattactttgtttaacaaaaaatggttaagttttttatttaaaaaagttgaaaattactatattcgtctattgaattaaaagtgtttaacaaaattatttattgtaactaattaactataaaataacatgaatactatatatgatattttaagtttatgaacaaagatatagtagtaaattttgtaagattaattttttattaaaaattaaaataaagaatgtaaataatttaatttttttaaaaatgcaatactaaaatgggcggtggtggtgaggattcgtgaaaaaatttagataaaaacaagtattataaagatgaaaattaaggtaaataaagaaggttttaaaatattaaagacaaaatgaaaataataaaaaaaatgaactcaaagtcttaacttttaaaaacataataaaataataaaataagttaatttattaaatatttttattttgataaaataaattataaagtaattaaattaattggttaaaaaaatagtcatagtcatatttatatatatgtatggcttttgtttttggtacagtatgtatggcttgtttggtatagaagatggaaataagtaaatgtgtcagcagttcatttagtaaatatgactatgactgcatgcatggtggggactgagtgggtctgcattgcatcacatattcacatattcacatgtgctctgcacgtgagtgtctgaacccgtacgtacccttctttttcctctctgccctcggctattagtatcacttataaaacacaatgcaatgggtttatttaaagatttaaattcaacatgaattaaaaaattgaacagtgtaactaaaacttttatagtaatagaaaagacgggggattcgtataaagtgaatcacatgcacatatacttgtaccaaacaaggccaaacataaaaaacatgaaaattcatgagaaagcctttgtgggggccattgcaattcatgagagcaagagcaataacacatttgaaatttggggacgctccaagggaccaaggctctcctaactttcccacattcctatgacaacattatgattaaaatccttgccccatcagctcagtggaaagaaaacaagttcctcctctctctgctttcatgaccctaaaagattggtaggcctatatgcaggtgaaaccacattttaggatttttttttaaacaattattgaataaaaataaattttaaattaaaatttagaaagagaaaaatcataaaatatctcactatttttgacttgaaagtaataaattattttataatttttttattgaaatcgtaaaaagatttatgattttttaatttttttaaaaattttgaagccgtaaattatatactaaaattgtaaataaatttatttatattaatattttatattttagtatattatattttttatatttttatttaatatattttctataaatgaaacactaataaaataaagttgtgaatatatgtgcgacgttaaagtcgaactagttggaatatactatataattagaagaaaaaaaatccttaaaattaggaaaaaaatatagaaaatattaaataaaataatattaaaagatataaaaatattaaataaaaatatataaaatacaaaaataaaaatattaatttaaagttggaaataatttactaatttaaggtcgtactcaaaaaaacttaaaacatcataaatttttttttaccacttttttcgtagaaaaaaaataaaagttgaaaaatgatttacaattctaagctcagaagtcatgaatatcatactacttactcctttctcgatatttatttaagtttatctctatttcataattaaaaaaaaaaaaaaaaaataccctgaaggttcgtttcgcccttatccggatattctccacctgatcccatcctctcttttacttctattttttctaaaaagaaagtgtccaccttcgttttcacctccttaattaacttttatgtaaaataatttaataacataaattacatttggcttgctagttttcttcttgacctataatacatggacatcctttaattataaatacctatataacatcttttgtttcttttcatttctttttgcagtattgcattttttatcatctttatattttttcgtcaaaaatgaatctaggatcccagaggtcagttggaacaatctatttaaaaaatgaatttaatacataaaaataaggtagtaagttcaaacatataaaaataaaaggtgtccgatattaaattttaagataaatatttatgattttattaaaataaaggggtatatatatttgtttaccctcacatgacaataagtgagagggttcaaacatataaaattaggtgatgcaatatgaaaaatataatattttaaactaaatacatgtgactttattaaaataagggggtatatttatctagcttcaaataagagtcggtttgtcgttgtttacaatgaaattgttttttctgttgtattttttcatctcaaatatatacaataaaaatacaattttatcgtctatttcgaaaacagatttatatttctattattgtttgacaggacataacttttgactcatgttcaattttagcttatagtatgtctatttcatgtaacttttcgagatgaatgtatggcaagtacccaaattctaatatatttttttttttaagaaaccttccttctatgaaaaaatggacttgaaagatttaggatttggagtttggagtgtaggcatggcagcgggacccgaacccgtaggtacccgcccaaatccgccccgattttaatgggaaaaaatcgattttttctgatttgggttcgggttcaggtttttcctggtagccaaaagcgggggcggggcgggggcgggtatggggttactgatacccgccccgccccgcccccgcccccgccccgtaataaataatattaaaaataataataataataataaaaatattattttctaattttatttaattgaattgactgattttgttttgtaattttaaaattatgatatcatattttaaatgtgggtttgttattattatttttttgttacataattaacttttttatccgattttttaataaaaaaattattttattttttaaattttaattaaatagcgggggcggggcgaggcggggaaaactcgacccccagcgggggcggggatggggatggggtttaaaattcgacggggaacgggggcgggggcggggagctggtttgggggtgggggacgggtatgccccgccccgttgccatgcctattggagtgtaacgaaaaaagaacggagaagggagtgggggtgttgtgagaggatggtgatggaaataagggaaaggttttgggtgtaggaaagggaggagggtaacaaagacaatttacattttcttggatgagaatatagcttattttgagagactataaatttgagagacaacagcttattttcttgagtcttgacctataaattacattaataatcaacaccgtcttacttaccataaattacatttgtcttgctagttttcttcttgatgtataatatatatgacaccttttaattattaatacgtcttaaatctcactttaaataaagatgaatatattaaatctcgtgtaagtgattgacccatatacataatattttatcttatattaatatatacaatgtcgaatgtctacccaaaaaaattatacaatgtcgaataattaactcatactcgtattatgttctcttaaaaaaaatgaagcaaactaatttttttcaaaaattaaaattaacttatatacctcattttttataagttggacgagtttttataaattttttattcattttatctttttattttatttttttaataagtgcttactgaataattttacccaaaaagacttttttaagatgatttttgattgattgtgggtgtaaaaactaaaactttataataagtatttggacaaaattttaaaagaaaaatagaacaaaaggtagggcattcattttcttggtgaataatgaaaaattgaaggaaaaaaaaccggagtgctgcaataattgtctcaacagggatttgagtactggcgaagcttatgatggagtggttaatgcaagcaaaggcatccaatcaacaactcaataatgataaaataaattattggattgggcaatattgattattactgtatgactctggtagcagtaatttgatttcacatttgcatagatatatgattttcgactgtatttatattctccctcgcgaaaatacaatattgtatgtcaaacaaaagttacagaaccgactcaattcaaatacggcggctagtccacaaggatttgcaatattgtaatctggatacatgacatatacgacagaataattatagatcgaatattaactacggattacggaaattccctaagacgaagatgcatgattgttattttctctttgcatgctttttgtggatgctggtagaaactagcatgcatgtagaatttagaaacgtaaattaaacagaagaacattgtgaaaaaaaagaagtgactgatgagacaacgacgtggtattatggcattcaattgttgtttgtttggtgcatacaacacattaccaatcatggcttgggggacccccccaccacacacacttccaaatcacgttaccacccgcaatcaatataatattggtgccgagatttatatttgagtaggaaaatgttgtctctatataacacaatagtctctcacacacacacgaataatatatatatatatatatatatatatatatatatattttaattcttgagaaatagttcattttattgtttaaaaatgcctttagaccgttagcattttaaaaaatatatgatagagtttactgcctggtcatcatggtcataatccattggtgattaatatctctccaatattttattctcatcctatgcacaacactataacaactgaaatcagaatcaatagtttgatcaggtgacctgttcaaatgattatatgaaatttgtggtgtatttaagcatgaggatcccttgtgggtctatatataaagatcaaaagtctttctgttaacatggaagccaaacatgtatttcgttgtcgtgaaatggtggaaagcatgttggcagcaatggataaactcttaaggcctaacaatgaaaggcatattggtagctacaatggatatcagatactctggatgaaaaaatgtttttgtttgaaaaaaaattattatataaaatagactcacacttaaggaaaagaatattgaagctaagatataaaggtgaaatctcataatagataataattaataagttaagcaatatataactaaaaaaatcactaattaatttaatatattaagattttgggttgaaagtgatgttttacttgtatgtgtatttgtgatctaaatcacaaattaatctaatgtcttaagattttgggttaaaagtgatgttttacttatatgtgtattgtgatctactgttgaaaattttctcagagtttttgagtattttatcttccaaaatttcacaacaaattatttttttaattaattattttcacgtttttatgctaaaaattttcttcaaatatcaactgtttgtactgttaatttttttttaaaaaatattatattaaattaccagatatattttagagtaaactgttaagtgtatattctctttaaatatttcttacacaatttatttttgtcaacacaatttcttcaaatttgtatgtgactaaattcacaacccgtagaacaagataatgaggatatgaaggagcagatataaagtgtgtaagtgcgagtgagccaaatggcaatgacacctcacacctattcgctgattggtacagatagggtatcttctcaatcttattggctttcataggtatttcatgtttgttctcccactccattcagtaagtgcccttgacaggatttcttgttggacatctatcttttcaaagcttcatgattcttctaataataataataatacatgggaagctgaccatttggattgttactttaattttattaaaacaaaaagagctttatgagttaattattagtattacacatcatatgaaagaaagaaagaggcatcaaaattgagagaaattaaatagaattgaaatgatataataacaatataaaactaattttttattagtataaacatttttaataaaaattaaaatagtaaaataaatataaatataggctaaattatgttttaagtttatgataaattaatatattttttttgagtctctaataaaaaattattatattatatttctaatatattaaaattttattttaggttgttgttaattaagtgatgatgcattatttttaaaattttaaattctgatttctagtagctaaaaaattatcactatttattttaaaatttaaatttataattttggatagctttaaaatcattagaattaagtaatgcaaaaaaaaaattcctcaaatcccaatcttcatcccataataaataaacgaataacaaattagataaaaaaaaaaaaaaagagttatggttatcagatagagagaagccatatctcagattaaaaaaacaaactcagaattaataacaaataacattcaaaccaagaagtcaagattcaacccaaatcaaagtggacaagttagatagtcagatagaggaatcaaaaatcacacctttacgattaaaataaaaattgattccactgtcagtgacaaaacgccaccatatctgcggatccatttctcactgactaaacgccaaggtaaatccgtttctcagtgggtttttttacgtagcaggaaacaagatttgtttttttttttttcattaattaattctagcggttttaaaaccaccgaaaatttgtcgaaaattataatttaatttttttaacttactcgatatttaactaacagtagagacttaaaacaaaatttctaatatattgtatatctaacttaaaaaatatattagaaattcaaaataaaatttactaatttattagtaactaaaacatattttaatcatatatatatataataataacatgatatactgtattagacataattttattcataaaaaactaatataaattatgaatgtaatattaaatatcagaataatatattgtatatatttttaatgtaatttaatatatatatatatatattaataattaaatttaaattaataaatatattaaaataaatgctcctgacattttccatttacttggtgtttggaaagatccatggattcggtctaatgatagttcaaatgctccatcagttcctctcatgggtctcgaaaatatgaaagtaagtgagttattggatcccactttgaactcttgtaatgttgcacttattcataatgttttttcccaaaatgacgctgaaaatatcttgtctatgcctttacgtttaataaacactcctgctgataagattatttgaaagcttagtcaagatggggctttttctcttagatcttcgaatttttgtatcatggaaatttttttggataacaatcatctctgtgaaagtggtaattggatggctatttggaatttgaatatatccttgcaaaaatgaaagattttatttggagaatagctagaggatgtttcccaaccagccaaccaggcaacgattatctactatggtattgaaaatgattggcattctttcctaggctgcactcatattcaacatgtgtggatggaagcttctttgtggcatattcttcaacatgcttttgatactccggaagatatgcgtaatttcatatttcacatcccggaaaaattcaataacagccaaaagtggagcaaattgttactgtactttggtgcttatggcggagaagaaagggagaagctttaggatggagctaataaacctgctggattgtctctgcagcaagcttttcagcagcttcaagaatggaacacacaccacaaacggcgaaatatacttccacctcaatctgaaatatttgaagaataatatggatgttattttttttaatgaagacaacaagtttggtgttgctgctgcagcaacttcttggttccaaggtcagccaaactccacaagaggctgaatctatggctctcctatttgctatcaactggaaaatagatcagcaactgggtaacattatcatagagacagattgccaggttattcctgatgctttcaaagcaaaaccatttcatgatctcgaagtgggttgcattttaagaatctgtgataaaaaattttatgaaattcataactgtagtatacagtttgttagtaggcaaaccaatcagatctctcataggttggctagagcatcaagatcttatgtttgtctacaaatgtttgatttcagtccttcttgttttcactctttacttattcataacttaatataagtttgcttcattaaaaaaaccatttttcgtttactagtgtatttataaatgactttgtgtgtttttattttattttattttttataagcgtgaactaatattttaacacgtgtaatgcacaataaacatgtttatattatataattaaattttataataaataaattcttttgaaaatttatattatattttaattaaattttataataaataaatatttttaaacatgtagattgcatttaaaaattatagtgaactaatattaaatttaaatgtagtgtattttaatgaaagtgttctaaacgaattgttacataaatatactatagagtaatgatatacatacattcatctattttaaatattttatcaatattttttattttttttatctttcttctaatcatatcaaaaaatttattatacatataatttttctctttttcaactttctctctaaatataagatagtgtcatgagtgttaaccaaaaatgtttcatatgctataagagattataccgaaacttaattacttcgtgttgtgttagttgggttctccttcatctttatgtgctaagtaaaaggatgtgtatttgcatagattctgatgccaaatcaaaatttagtagagtaacaatactgatatatgaattatttatatctatttgaggttgtcatgtagtatttgtagagaatatagacattatgttgtgtgattttgagcttgtcgtcacacatctaatgtaaaaaatccgttgcaaaatacatagttttgtatgtaaggcttatgtttacagaggccgcatgattgacaatcgtggctttgtgatttaaaggagtaatacttaggcgacgattattcttaaaaattgtcatacaagttgtgtagctggtcagtgcaagaggttgattcagttaagtaatcttctgctgagcaaaattgtttgactttttttttttttttttattgaagttgtgaccttattacacttttagaacaagtggtaatacaatattaattatagtattaagacttgaatattccaacaacaaacaatactcaggaaaagtgtggcaacagaggagggggagtttggagaacttttttgcttatgggagaaaaagttattcataacgttaattaattaggcgaacaaatgtggaatcaggtttaatatataagaaatttaagtcattgaaagtcaaaagaaaaagagttggcatgtttaacataaaataagaaatatcacattatattatcaatgagagcttcgcgatatgttatcttaagcaaatcgaaggaaaacaatcaaagaaaataaccgtatggaagacctttaattttaatatgttggtatatataagcatagaaagaatcctaatgaaataaaaatacaaaaaatgcttcctatattagttgtaattaccttaattaactcaaattaaattatattggacaatcaattaattgtccttttatatttgtttaaaatattaaaataaactgtgatgaatttaaagcatttaaaattataaataaatatatagtacataatattcagtaaatatatatctaaaataaattaatgttgatttaaatttttgtattgaacaatcaattaaaattgtggatgtgtatgtcttataatagtaaaatatacctgtgtgaattgatttaaattttactatataaattttatttgtacgaatcaattaaaattatccttaatcattattactaatagaatcatttaaattttacacgtatatttttataatagaacaaatttctatatttttacatttttactcttattaacaaaaaatatatcatatcaatttaggcagttcttatatttactatataaaatttgaaaaaatagaataaatataaaattagaatatttcaatttacaagattgatcctcatatattatatttaatttagaattctataagtaataaaataatataaaatctacttaattaaattattttgtgtgaatgaatatgacgtgtcatgtgatatcaactcataaaataaaatgaaataaaaatatcatatcaatttacacaatttttatatttactctataaaattttaaaaaataaaataaatataaaatctgaatattccattttatactattggtttttatgtattataactaatttaagattctacaattgatttaatggatttaagattttattggaaatagaataatataaaatttaattgaattatttggtgcgactgaatattgggtgacacgtgatattaattcattatcactaaactaaaaaaaaattatcgagataaatgagccctttaaataatttttgacctttcaaaggattaattcttgaaaaaagaatattctacatatctgactttaacatcaacaaaaaaatagaagcaattcattccatgatacgtttgccgtaaacacatccatatgtggacaattctttggtattttattagaaacagatgattgagcgggatagtttcattagtttctgcgtctagggcaacatgacatttatattgttttaaatacttttgtttattactttgaaaaggcattgaatatttttatgtttttaaaatgttaaagttccttgttcatttaatatttggagggaaaatatgaaacaataatataaattaaaatacataactgaaacttttgattttacagttatttaaaatattttttcaacaatattataatatcattcttttgtttatatttatatatcataatttaaatggtttattataaatttaaaatataaattatatatgaattaatatttatatactactataaattttaattatataaaaagtattatctcatgcggtagaataaaatactattaagaaagtatcattaaaaagtatatagcaattgtgagaggataagatggtgtagtatttttgaattgaaattacgtgttttagtagaaaaaggaaacaaaattgtaatgtagtagttcggataaagctgaaagaattgaaggaggcgacgatattcctagtaggaggaatttaatataataagaaagcagatggttgtaagttgtaaccgaaaggaggaaggggcataaccggaaaaggaaataaattagagcggaggcaggcgtcaaaggtcaaattttgaagcttccaaagtgggaatatgtatgttaggtgtttttcgcggatgatatcagatgttatgttccaaatttcactcttaattaaacacgaggaaactgtgatgaattgagagaaacactagtatataaatagagttgaaaatgaaaatgaaaatagaaaataaaatatttgatataactgtataataagaaagaagggtgaagcctaaaatgaaataaaagtttaaattaagttgaagaaagataaaagtgagagagaacaccgacgaggcagaaggagagagagagagtaataaaaaaaaaaaaaagaaacggacgaagaagtccgtgctggcaaaagattccctgattcattcactaactggttgttttatgttggtgcctgcctgcccagtaactctactgtactgccccgcttcatagttgctactgctctctctttctttcttccctgtggctgtggtgttaaatagcaattttggttacaattagaaaccctaaaagggaaagggaaaaggaaaaggaaagagccatggggtgtgccagctccaagctggacgatctcccagcagtggccctttgccgggagcggtgtggtttcctggacgaagcaattcaccagcgctacgcactggccgcagctcacatcgcctacatcaactccctcaaggcaattggtcactccttaaaccttttcattcagcaagacatgctaacaacaaccgatgctcctccctctccctccccttctccccctcacaaaaccaccaaacactcctctccttctcactccgactccgccggctcccacctccacttccactccgactccgacgaccttccctccctccatcattcccctgaaccatcctctcctattcgtttaggtgcttactactcaggaccagatcatccccatccccatcttcatatgaattacatgaagaataaagccgctccttcaattgtctacgagcagcgccctatgagtccccaaaccatgtacgttggagagtcctcctcttcctccttctacccttaccagtatcccccttacccctacacctacgatccctattcggccggactttcttcctcgccgcagcgccaggccgtttccaagccacccccgcctccgccctcccctcctcgctcctccacctgggacttcctcaacttcttcgataacagcgacgacaagtactatccccaaactcattaccctgccacggccacccccagccgcgattccagggaggttcgagaggaggaggggatccccgatttggaagacgaggattaccaccacgaagttgtcaagcaggtccatggggatcagaagctcgtccagcctcctaagcacgaacccccaccctcctcccaccacgacgtatatgatgatcatgatattcatgatgatgatgatgatgatgatgaggacgaagaggaggtagaatatgaggtgcacgtggtggataagaaagtggttggtggagataataatgatgggaacaagaccaaggagcacgccgcattccgtacccggcgacctggttcccggaatccaattgaggttgctaaagagattcagattctatttcagagggcttccgattctggtgcccaaatcgccaagatccttgaggtcggcaagcttccccacaatcgaaagcacgcagcttatcaaggtaacattaacagcatttctctctattcattattcacatttcgctcctcacttacctttacctgatcacgtcctgtctaccagcttcttccaagatgttacatgttgttgctccctctttgtcccttgtctcctcccaaccttctacttccaaagatgctgaatccgcctccgctgctaacatggattttaatgttgatctaacaaccggggcacgcaatctttcctctacgcttcagaagctccttctttgggagaagaaactctttaatgaagttaaggtatggatcttaattcaccaatctcattccattgctttcagtttttccacttttcatctccgtgaggcaatttaatcctgctgctttcgcatcagctcttgtatgttctaatgtaaccaacctgtgctgataatttgagtgatatcaactgctcagaagtcttttatgccataagtgaaacattgttaaccagtgtttacaggtttccaaatagcttttttgttagataaataattaggaagccataaacaataagtatagcagtagaataagttcaaatagaatcataacacatacaaagtttataataatcaattaatacaaagcttaaaatttaatagtagaagagtttaaaagagcctagattgaagtgcactatgcgctatccttatagagaaaaattcccccactacactggtacaataaattaatatgcatgcgctcctctcccaagatacgacaacccattaatccaatcgagtatggcgaaaggatcccgaaccaaagaacaccatgctccaaaacatatagttgtagtaatataatgtaattttataaaaaggagaaataggcaaatggtattttgctgtaggtgtgtgcctatacgttctccttatttttccataagaggaagctatatataaggggggaaaataaccaccaaatgtgcagcccaagtatcacaactaacaaaccagtaacaaacataactacaaatctcaataacgtgcaaaacgcctccaacagataaaaagactaaaaacttagtcaaacacaatttctaaaagataggaataaatagatagggaatagtttttatctttagaaaaaactgattgagaaaaagaaaattatttattttaaattttaaattataggaaaatattttccaacatttttttcgcacgttcatttgtttgcaggcagaggaaaagatgcgggtcatgcatgataggaagtgtcgcaggttgaagcgtttggatgataggggttctgattttcataaagttgattcaactcgaactttgattaggaatctgtccacaaaaattagaatggcaattcaggtggttgataagatttctatgactataaataagataagggatgaagaactgtggccacagctgaaggaattaatccaggggtatgtgatgttaaaaactaaccatttttgttatttgttcaagtcctaaatgtctctctgttcatgatgggcaactctgtatgtagggatggcaagtaatcccatatctatgctccaatccaatccaatccttccattcccccccccccccccccccccccccaaaaaaaaatccatttcttcttcctttccatcaccatgtgatccataaaatataacatacttttaaatgggtgggttggatatacgtccctaattttttttattaattgatgggttggatggttttaattaaatggatcaggaatggattggattttttcattatattcccaatggatcataaatatgtgaaaaaggtttagggtcatgtgttttctacacaaaatttgatttgatgtgcttctattttaggtgcttgtctattatcattgaggtgatatagaatgacctcatgcaaaatgtgtagatcatcttataacgagtcagtcaagcattttctgcctgttcagtggcactttccacttttagctgtttgtattggcttccagtaactgaactaattatgtgctctacaacattagacaaagattgaatggaaggggttattttgttattgagattccattccataggaatcatctcctctatatttcaaccctatgaaatgaactgaaatattgatgcacaatttcccagaattctttgataaccatggtgaaatgtatatatcctgacgaaatccaacaaatccacctgcaatctacacatagtgctgatagaaagaagcaaatacttggccatcttctaagaccatttctgataattttgataaatcctgctatttactctgatgtatgtttataacttccaaccatatgatcaatttggtggtttatctgtccaatttgtggataatgttgtgctcgagttgtcagccagaggaataatcattctttacaggggagatgatgcaaccacgcaagagcttttccaagaaattattactctccaatctacaagaggaactaaaaaccttaaaatatatcctgtttatccttgtgcaagtggattgagcacttgaattcagtattctccatccagttttccgttccagacatgtgtgatgttgtcacccatgcgcttttttattcttcttaagtttgtatggttgaattaatgttctcattttcttttgaagttgctaatttttttctctgtcctttgggataagacatgcatgtgagatatccattcatacatagtattggataaatgttttgccttttctcattgtaatgtaattatcacctgagaattgtttgggtgtctcgatgtatatatggtataatatgagataagcttattttcaggttgaccagaatgtggaaatccatgcttgaatgtcatcatgatcagtgtgaagcaattagagaagccagaatactgggttccattggatccaggaagaagagcggtgatagtcatctccaggcaaccaagcagctcgaacaagagcttatcaattggacattccaattctctggctggataagtgcccaaaaaggttatgttagagcattgaataattggctgctgaaatgtctcctgtatgaacctgaagaaacaccagacggcatagtcccattttcccctggtaggattggggctccgcaaatatttgtaatatgtaatcagtggtcccaagctttggatagaatatctgaaaaggaagttgttgattccatgcatgtatttaccatgagtgtgcttcagatatgggaacaagataagctagaaatgcataggcaggtgatgaagaacaaggatcttgagagaaaagtgagaaatatggatagagatgaccagaagctgcagaagcaaattcaagcattagagcgaaaggtggttctggtatctggagaaggtaaaggtctttcagtttctgagaatatcatatatcagagtgacaaaagcagtagtctacaggctagcttgcagtgcatttttgaggccatggagagatttactgacgaatctgtgagagcttatgaggagttgctacaacggagcgaagaagaaagtgctgcccaaaatcatgagagagtttcatagggtggtgtagctgatggaagttggaatcatattatctttgccatttaccgagaatagaaactagctgatctccctctactaactattctttacaacagagtcttgggaggaggggttgggtttgatttctcactacgctaagctaactgcattggagctgaagatactgctgggatgggacagtggaatttattgtcaaacgaaaagataagtgtgaggtatgaggcgcacggttgctttttgggtattcagtgctataaggctacaagtggagttgtgctgctaaaagacaggggagcccacaaattataacatctaaatggttcttctttctgcattagaaaatagaaatgaaggagaaggacggactttcaggtatagaacccctgcaactggcaagtcgtgtgctagaaggtgttcattgctcaaattgaagcagtaaaattggaacaagtctcgttcgcaacggagtggagtaacgcacgtcactgaatgcatgggtgttattggttcctgtataaaaacattcgtttttaagttaaattattgtacagattacctattaacactgagcaggcttgatgaaaaagcatttagaataaaatatttcttatagccatttgttcctcaactggaataaattgctgagaactgttcaaagaatgaaaacagaactccgttattaaatgcaaagcaacttaaatctgacataagtggtggtgggctcttccgtgaccaactattgttcatgataagatagacaacggagattggaacgggctggccaaaccagactccaagagctctcaaagtgaaccaacctcttcaccaaggctgctcaaaataaccagttttaaaaaaataatcatacaagtagttataactaattttatagttacggttatttttattgaaaaaatagttataattataaatctataaaactataactagttttatagaaatgattattttaaataacttatttttattcattcaaccggttatgtaattgattttaaatataacttgttaaatagttgattatgcaattagtttattcataatctgttatatatctatattttaaaaacaataacaagttatatcaaattataactaattgtggtcataattataatattcacttataatctagttatttattagagcatggttgaaaatcagctaaaaaaataagtcatgttgaagtaatttatttagagcatgttgaaaatcagctaaaaaattatttttgagggaaaaatacttttacaaaaggatcaagatctttacgttttctttcattttatttttatcctttggacctacattgaaatgtataacacaacaatttcaactacaaaccaaacatgcatttagggtatattagaatttttggtgggagggtccaaaaatatgtttaaaagtaagctaaaatatatttgtgatctataataaatatctaaattttttgtttactccttaataaattttttcttcatttttactttcagataaaacaataattttatttttatccttgacactttttttagtttatgataaattagcaaatgaacaaatacaaaatttactaatttatcatgactaaaaaaagtgttaagaaccaaaaataaaatggttatcttattagagatttaatgaagaaaaaaagttatcaaaaaaaaatacaaaattcaggtatttattaggtttacaaatatattttaaccttaaaagtaaaatgattttgaaattatgtttaattaatatctccaaaatcaatttagaaacttaagtttgacctataagattaatgtgcaaatgaaaagagaaaagtttattagacaacatggaatcctttgcaaatcactccaccttgcacattaactctattaacatttatatatttttttcttctatttttcattctattatattatatcatctatagtacttataatgtttttgatccttttttgtctctctgtcaaatatcatatggtgtactctcatctctcatcattttccatttataatccaactttttggcgcttgctattgtgaggtgttaatgaactttgcattttgttcgcctataataagtaggtgcagaggtgttttcgagggattggattgtcagtgctgctaatctttgtgccaccctacggaactgaattattcccatatgatgttttttacttcaattattgacatacggtaataatattttgtctgtaaaattgtattacttaattgcattattttttttcatatatccgtacaaggaggggggcttactgcttacgcgcaagatttttattttattgttgtccttttcagcccttgttacgaaattgaaatgtgattcttgcgttgcgtggtacattgtcatttaacaaaagctgcacaaagatgttattggttattattgaatttgaatagggaaattttggctagcagacattgttaactgcttatcatatgtaataattgattataacatgcatacgttacattatttatgaaatatattttataattttatttttcttttttaattatatgatataaatgtattgtataaatataattttgactaatgtttaatggaaattgttgtattaacaacactccaagtaaacgtacgaaagttggtgtaaaatgtaagaaaatgtgtcatccattgtaggcttttttcctaaaagggaacattttttttttctttattaccatttagagggtcaattttaaataattatctaaaaggggataaatcgtaatagatgttacaaattttaattttttagtagaagtcgtaaatgagtttacactttagtttaattattttttaaaatttacgattttaaagtcgtattaatatttaaaaaattgaagttgtaatattatttactactttaattttttttaagaactatgacttgaaagtgataatgttttttacaactttcaagttgtaattttttttcaaatattaccattttaaaaaaattatgaattgaaaataataaataatattacgacttcaattcaaaaaagtaaaaaaaaaattgatacgattttaaagtcataaattttaaaaaataattaaactgaagtagtaaattctttaatgactttagttaaaaaaaaaatatgttacgggttttaactcaaaagttgtaatcgtattacaacttatacttttttggataattattgaaaatcgacccccaaatggtaataaagaaaaaaaatgttctcttttgggaaaaaaaaagctcgatttgtaggattccatgttgtatgataaacattagaaatgagtagggcaaataaaatcataggttaaattagtttgttggttttctaattgattttttaagtttgatttgattttttaattttttgagatttaatttgttctttttaaaattgatttattttgattctactatgtctaaattgagtcaacggtattaagaaattatattgtgactgctgaaaatcatttaatgataattttaaaccgtcgtaaaatacatatttagacactaagatcaaatttaaatgaaagaatcactcaagttaatgtaaacaacatgatcaaattaaactaattttacgaattagaaaattaaactgaacaaaaacaaaatcagattactaaatcaaatcaattttaaaaattagatgactaaattgaatatgaaaaaaaaagcaacatatccagggggggggaattaaccaaaattatataaataattataattataattatgtttggcggtcacttcttagttcatacctatgttatgcagcacgaactctcaccttaaaaaggaaaaggaaaaactttgacttgattagaatatgcatcccggcacgtgatcaatggtaatggagaaaacatttcacgaaagggagagacaagtcttaaaatgcagcattgagcaacttaattaaacggatctgcgcagaagcttccctccaatcagattattcttttttggtttcagattctcaactttaggcaagtgaaaaggtaaggaatcagatttatactagaaagaacaactttcagccataacaaaccaagccttttaatatttcaacacatatgatttattagataaaaatgtaccaaaacaacaataagttattttaatatataaaatttattagataaaaattagatttaaatgtaattttgatttttctattttattcaattcacaattttgattatttattttaaaataaaaatatttgatcattttattttaaaaatttataattttatcctcatattttttagaaatatgcaattttaatctcatctttaattttatttgtattttatttcttacattataattaattaaattatttttaatgatattttaaacaaatatgttaaatttaagatttaattaaatcaaaataaaataaataaaagatagataaaattaagaatttaattaaaattaatttttaaaatcatacaatttttaaaacagaaaagccaaattaaaatgaaaagattaagcaaaacaaagaaaacaaaaataactttgtgtgatataaattgaacccatatgatgtttatcttgacttgacgtgtctaggttgagatatattagtcggcaaggtatcattggtggagctagctagatttggaagatatttgtaatgtgtcggaaaaaccaggtaggaagtcagggaagattttacttttccgtaacaaaaaaagtggtggtgtcgtggtgaatatatataaataaaaaagaaggtaaaatagtaacaagaatgggaagcattgatttgggtaggtgaagactgaagagaagcagaataagtaagatagggttgtagttaaagaaagtatggataaaaaggtaatattgaggaagagcatatgatgaagttggaaatagatttaatagaatattaatgagtgctggattgtaataagtaaacagtgattagtaattagcaacagtgagggtgaaggaagggaagggaagtgaagcatagcatagaaacaaggaaactaaaaaaattgccaaaaaggcaaatcacgcgaacacaagagtagaagagtatagagtctgtggagatctcattcatgatcggtgataattgttgaagagagagagagagaggatgggttgttgccaatcatcgatgttgctgagagtgggagagagggagactcaccctgatcaggagaaggagaaggagaaggagagggaaaaggaaaaagagcaagcgtacggaagccaccagaggcagtctgagggcgagaaagagggggtggatttctcgttctcggagttctcgctggcggagctgaaggcggccaccaacaatttcagctccgagtatatcgtgtcagagagtggggagaaggcacccaacctggtgtacaagggtcgcctccagaaccagagccgttggattgctgtgaagaagttcagcaaggctgcttggccggatcccaagcaattcgtcgaagaggcttccggcgtcggcaacttgcgccatccacggctcgctaatttgatcggttactgctgcgacggcgatgagaggcttctcgttgccgagtacatgcctaatgatactcttgccaagcatctcttccactgtatgtgtaacttatctgtttgttatctgtactagtgtttatctcatctgttcattcattcattggttcattgattcaggggaaactcagactattgagtgggccatgcgtttgcgagtggctctgtacatcgcacaggctttgcattattgcagttctgaggggcggcccttgtaccatgacttgaatgcttaccgtgttctcttcgaccagcaaggtgatccccgtctctcttgctttggttttatgaagaacagcagggatggcaagagttatagcaccaatcttgcttacacacctcctgaatatttaagaaacggtaactaactcccttcttcacattttcttttttacttttttatgtataacaatacttctctcaatcatatttcttttgttacaggaagggtcacgcctgaaagtgtcatttacagctttggaaccgttcttctagacctcctcagtggcaagcacatccctcccagtcatgtaactgccttctatccttaacctgcccctctcttctgattccacatatcactaaaagctgtaaatacctctatgtttttaatcaagccattttaatcttaacatgcaattctcactttcagtgtttttccatcttgactattattgtgttaataagtgcttgttatgacactatttattttgtcgcattgaagttgtgactgtacctcaaatgatattacgttattgttcaataaatgaaacatgatcttatacgaatgacaacttaaggtatggaaacctttctctttgattaaatacttaaatacttaataatggaagttgatgatgctatgatagttatttatttaaatttaacgtcaattcattttccatatgctcacgtgttcaattagttttcttcttggttggtgccatatggagttatctgattgtgtttgcaggcacttgatatgatacaggggaaaaacaatatgctcttaatggattcacatttagaggggaagttttcaacagaagaggcaacggtagttgttaatcttgcctctaaatgtttgcaatatgaaccaagggagcggcctgatacaaaggatttggtcacaacacttgccccgttgcatacaaaacccgaagtacagaccccttctctaacttaataatggaacatatgatttactggaactttgttgtttcaacagccctatcaaatattccattatcacctacacaaaaatttatgttggatgttaatgtctaatattaaaattctatgactttttatatttcatatttgtttctttggtcactcatttcaaaattgaatctacatggttggggtcgcttagctcaccatcctcaacttacataaaacatggtaattcaaatattaggctggaacattttaaattgtctttggagaaaatttagttgaacctgggttatttgcaaaagttcattttgactctagggtttctttagtccgtaaacttttccacttgcttgagatgatataatattataagggttttctgtataagtaaggttaaaagatgtttgatatgtcaagttctcaaacagccaaagtaattggtttatggttctagctgacttgtgaattctagttagcaaagaattagtcatctttgctggtttggtccttgtttcagagttacattaataaacttcattcaccccaaaataaatcttgtgtgtactactgttagtttattacttgtaaaggatagaagaaattttagtaattttcatgatgtgatattgtctagaaatataggcatatgaccttcaaggaatctgttctttgtgtacatctatctcaaagagcttagtcaagacttattttattttatttttaaaatctatagccagttcttagaatttgagcttagggcataattcagcccccacaaaattggtattaaagtggcttctaagttgaggattgccaaagccttcgaaagactacattggtcatatatttagttgatgtgagatcttaacacaccttcatgcctaggaatagacatctagagcatagacaaatactggtgacccaataacggatgtaggattgaccttgataccatattagaatttagatttatggtctaactcaaccccataaaatcagcttgtaaagtgaggactgccttttgaagttctagttaagtcgcatctctaaggcaggtcaaaaaggccacattaataggagtgacagcaattaaggtgactttccagcacaccctctcacacctaaggttatgggcctagatgttgcaattgggtggcccaacaatgaattttggataggctttgctaccatcttggaatttgggcttagagcccgactctaccctataaaattagcttgaaaaaaccaaattgatgttagattttaacaccttttgcctcacaacccaataacaataccctctcatgcctaggaataaccatctagagcatagacaaatacgggtggctcaataaaggatctaggataagctttgatatcacattaaaatttgggttaggcttagagtgtaactcaatcccacaaattgacttataaggtgcggattgctcaagctttatatgctctatttaagtcgtatctctaggtgatgttgggctaaacacactccattgaggctgtagtttagccaactccccaggaggttgcaattaagaaggctttcttaacccccaccccccccccccccccttcttctctctcaaggctatataggctcggaacatggtaatgtgggaggcccaaccacgaatctaggatagatttttgggatcattgaatttgggcttagggtctatctcaattccacaaagctgactttaaaaattcaatttgtaaggtgacgattgtccatgccttataagaactacattggttatatctcaagtcaatgtgggatcttaatgcgcccatgacccagtaacagcccttcatgcctaggaataggcatctagaatgtagacaaatacgaatgacccaataatggatttaggtttagctctaataccatcttaaaatttaggcttagggcctaactcaaccccacaaaaatggcctgtaaagtgagattgctcaagctttataagctttatttaagcttataaagagcatagtcaagactttttatctatagctagttcttaggatttagggtctaacttaaccccacaaaaccggcttttaaaaaaccagcttctaagttgaggattgtccaagccttataaggataacattggccgtatttctagttgatgtgagatcttagaatttaagcttaggaactaactcaacctacaaaattgactttaaaaaaccatcttgtaagttgacgactgttcaggccttgtaaggactacattaaccttatctccagtcaatgtgaaatcttaacacactccttgcgcccatgatccaatgacaacaccgcctcacccctgggaatagaaatctagaacatagacaaacaaaaatggcctaataaatgatctaggacatgttttaagatcatcttaaaatttaggattagggtctaactcaaccccacaaaaccaacttgtaaggtgaggattgttgatgccatataagctctattaatccatatctctaggtaatgttggaccaaacacaccccttgagactgcaattaaccaaaaatgaatttaagataagctttgacaccatcttagaatttgggcttaaggtttaactcaattctacaaaattgacttttaaaaaccagcttgtaagattttcaaaaaaagaagaaaacatcttgtaaggtgaggactgcccaagcttaagagtactacattggctattctctagttgatgtaggatcttaactctcccctcacacgcatgtcccaataacaacatctcttcatgcctaagaacatacatctagaccatagagaaacatgggtggcctaataacgaatctttgatggactttaatgtcattttagaatttaggctcaaggcctaactcaactccacaaaactggtgtgaattgcttaagctttataagtcacttctctaggtgatgtgaaactaaacacacctcctccaggttgctattaaggcaacccccaaatcctcatgctcatggtggcctaaagcatgacaaggcaggtggctcaacaatgaatcaaggataaattattaacatcttagaataagaacactccctcacgaccagggataacatctagagcatagagaaatatgggtggcccaataacaaatctaggttagactttgatacttgattagaatttgggtctaggtcaaccccacaaaatcgccttgtaaggtgagtattgctcaaactttataactctatttagaagctatatttctaggtgatgtgggactaaacacaccctttcacatctacaattaaggagactctgaagaggctgcaattaaggcaagctaagggtaattgcaattaaggcggttttccaacaataaacaaattttaattcatatttttcaagcattttaaatgtaggacaatctagtacacaaggctccaacctaatggagtttagggagggtagatgtatcaggctgccttacccctgtgagtggagagaggttatttcttggatttgaatgtgacttcaaagtaagacaacaatgttatagttgttcaaggctcgccctctatgtaagcattttaatttgtgaatataaaactatttatgtagactcttaattgtattgcatttatgcattatataaagacattcagttggataaggataacccaattgttagactcgcatgatttcaaattttgagcttttggtcatacacctggttgaatgactttagggctgagcccggtgttacttttaagtttgcatttacttgcagtttgaaaaatcttaaactatatgatatgattttcatgcatgtacattgaaggttttgaactttatatagccatcggataaaatttagttatctatctataaattttaactttgcattcatgcatatcttacaagaatcttttaagcagtatgataaaaatagggcacaagccaaactagttctatctttgcaaggctgaacgtgactaaagaaagttcttccatgctttttgtatacttttttcaatttgtcatgcatgcaagtatttttattgtcttccttgtcttatcatgtatttctcagtgtagaaaactagagaagggattaaagatatatattgagctatagcaattccaacatcttctgtcacttgatatggaaattatccttgttaaatggcaatttagacatataaatgggattaaagcagaaacaattctagttgactattattatgtgcttcaggttcgttctcatatcatgcttggaattccaaagcatgaggaagctccatcaaccccacaacgtcctctttcagcaatgggtgaggcttgttcaagaatggacctaactgcaatacatcagatcttggttgcgacacactacagggacgatgaaggaactaatgaggtaactgatgggtgcattggttttaaattttctatttttaattggatgatgtgccataaggtttgaatttggattggttcagttgtcgtttcaagagtggactcaacagatgagagatatgctggaagcaaggaagcgtggagactatgcattccgtgacaaggactttaggacagccattgataactattcccaggtgcaattctgcacttgtttgacattgtaaattattgtagctgtgctatgtgcacgctaattattttgagatgcttctgcattgttattcatgcagtttattgatgttggaacgatggtctccccaactgtgtttgcaaggcgcagtctatgctatctgttatgtgatcaaccagatcctgcactacgagatgcaatgcaagcacagtgcgtttatcctgactggcccacggctttctacatgcaatcagttgctcttgcaaaactggacatgcacaaggatgcggctgatatgttaaatgaggcagctgcattggaagagaagaggcaaagaggagcaagaggatcatagttttatgcagtgggctaatttgagggtgtcaagttctgtataaaggttgagctgggaagcaaaactaacgtttgaatgagtttaaaatgtgtcagagaaatacaaaaagtggtggagtagatggcacatgcatttttatttcaccatcttataggaatcggttacaacttgaaaactgtgcttgtgcactctaaattgggaaggaataccggtaatttttccattgttaatgaaattgattggttgatgcctactgggttacttactgtcaaacaggtgtttattgaggttattctaactcttcactggtcaaggccatggtgttcatgacattatgtgatgcctgcataattcggtttatttttcaatgattggtaaaatcctgaatacaaagtaccggcccatgcccatcggccatagcagtaggcagcatgcacgatttttaatccagcgctctattttgatctttagagatatttaaaatacttttgtccagtttatagaaatgtaaattataaatttttgtttctctcattacctttggggtttggtttgatattcccttggatccttttagtttaggacagcttccgttactttagcctatatcataccaaaagctactcctactttcaaagttactcgtgcttcgtctagcgtctattgtacaaagataacataaacgttagaaaattttatgggtttgaaatagtagtataagttgagaattttagatgctgtcttaattaacttagtatatcctttatcataaacacttagaccccattttctaatattccataaaggtaaaccagttcaaagggaaaatgttttaccattaactaacatagaattgttctagattaatcaatggtattaaattcacattttgaatatttaattgtgttaaatatttagagttagaagtgaaattttgttgttcataattctatttaggtcgagtaagattatctttcatattaaataacttatctatacaggaaaaaaactgttttaatggtttcagattatatcgattgattttgccatgtaggtttttaaacaaatgtcaattctcattacttttcctaaagtgggtacatgccaacaaggatataacctcatctaagttccgagtgtttacagattggttgattcagttttaaggaagagaaaaatgaactaatcaaaataaattagattaggcggagagagggaaaccaagttcatcaagaaggaattggtttgttttttggttgatgaatttggtttccattctttttttttggttgatgaagttgctccaaaccaatagactcaacgtaaatattaatgttttttattagaattttttggtacattgatttttgggtacattatttacttttgatttaatgcgacgtcattgtagtatcatcaaataatgtatcttaaattttatatctatattgttcaaaaaaaattactttcttatttctaaaataagtgtcattttaggtttttttttttttgtaaatcaagaaaaattaataaataaatgaaagataatagtaattttacaaaattaaccttaatgttaatattgcattgcaaaactaaagtgatatttattaggattatcaataaaaaaataattaatatcatattgaaaagataaatgcaacacttattttgatttttttcttttcaaatacgatatttattttggaacggaagacttatatgcacattacttgaggattttaaacttaaaacaattaaacaaaacacttacattctagatcaacaattggtaaaattaattgttcaaataatttataaatataaaatgataataacaaacatgtttatatgatatttttatacaaagtttaattttaatttattgatcaaatatattttaggataattataattttattttttaattgattttaaagttttgcaatttttatttatagattaattattctaattatatttttttagttttaattattatacataatttcattatgcattttattattaatcttagattttatcttaaaatgttccaaaccaagtataaaataaaataaaataacatactcttaagtagatgtcatattttcattatgttaattagtggactagttaaaatatttcgaaatatagtgttaaaatcatacaataaatcatgtaattagtttaatggttttttttagtaatggtttaaataaatagtataagagaaaccaaaaactaataaaattatgtcttacctaaaaaaagataataaagaaatttaataaatattttatggataaaaatataaataaaatataaaaattagaagttagtattttaaaaaacgttatttgaagtaaagtataaaaaatgttataaactattaaaataagtttgtttataaaacattgttaataaatttagacaaaattttcaaataattaaaaaaaaaggttaaaaatttactaaaagtatttggcaaaacatacacaaagttaacaactatttactcgattacttctccttctatgatgaccaaaataccaaattaatcaatttatattcactctccactttatcattaacattgttatacaaagtaaaccattcttaagaaagggatgatagaccaaatagagacatttttaaaaacttttttactatatattaaaaaaggctcttccaaaacatattataaaataatttggggtttttttaaggcatgttagaacaaaattaccaagttaattagcaatttttgagccacgtattattattttgtatatataaaaaaaaaaaaaagacttgcacttaacatgcatgctaaatattgttgaaccaaaagggcgtaaagtgagagagtatgccaaagtgctctattagggttggggtggagacttcaaaagaggaggcggagagcagggatgtgacgtggcaggagccatagaaggagtgcctccgcagtccgcagccacagtctaattaaggaggacccacgcaattaagtgtgtgttagcctctgttaggggtgttcgtggtctggattggatcggttttgaagcaaaaaatcatccgatccaatcccttcggtttggtcatttaatcatccattcggtttaaattttttttcaaatccgatccaatccacaccatttctaattttcattggacaaacatgttcattggacaaaataaggagcaatatattgaatttttgatttttgggctatgatgaggaataggcccaagtaggtaaagggtaaggtatagtttataattggatcggtttggattggatcggtttccactagtcaatccgaaaaccgatccaatccggtgaaaattttcggttttttttggttttcggtttttcggttttcggttatttcggttatcggtttttcggttcggtcatcgcggtttgcatcggtttggatcggttgatgaacacccttagcctctgttaagcgcacacagagtcatctcattttagaatatttcaccctaaaattttagatgcatgtgtttacgataaattcgtaaataaatagattacacttcaatataaagaaaagttatttcaagatagagagtcttacctttaagaggctttgaatttctaatccgatagagaatccaacccaacttaacttctataaatactagcaattaatgttaatgtatcaggaaaagtggtaattgaatacatttaatatatatcattaccttggtaaaattcatactaactcgagtatcattgtgtcaaagtgttctttgtacaagtatatattcacccatttttaatggtttagtctcatcagagcatcaggcaaactaaacagattttggatattaattgatcagcggaggagtgactagtccataatcaacagtccaccttggacatattagcatgtcagacacaaaaaatgttgacatcagatgaatcagatctatgaaaagtaggggaagatgaagtagtaaaaggaatatgtgcacaatttaatttccctcaccaatgtcaagacttgaatgcaactagggtttgaccacaaaatttcttcatgatacaatgaaaacacttgagttttttttgccttttcaaaactcaaggcagataataatgatgtttacaaaatgataattttgttttcatttttttttttgaattataatttttttattggatatatatatataaaaggttaacttagtgataaaagatgtagagaggaacaaatagattgtggattcgattcctctcgataataaaaactaacaattaaaaattaatattttactgataatatatatatatatatatatataatacaaaaatatgataaaaaagaaaattctaattaaaaacaaaataatttgattttattaaagaacaaaatatttgttatgctgattattttttaagtattttttttttttttgacaaaattgcctgaaactcatgttttcttaaattcaattgtgaatattattatgctagtaatacctatactatttttggtgtaagttttctatgagattaaccaaaggtaagacaaatgaattttagtacaattggaacatgaaagaatcatacaattgctatatatattttgggattaaaagttgaattgaaccttttatgaaaattatatatttttcaagtggcgtctttttgaaagaaaagtgacacctctcaaatgaaatgatgtatattttaaaaaaattataatttttgaagtaattttcatttaatgaaaaatcacatcttttttacttgatatcgtatatgaaaactcacttttatttttaaattattctttacgaatagatttgtattttcaatgaaacaatacaatcttcaatatgaaataattcagttttcatgaagaaacacaacacttcatattttgaaaatttatgacaactcataaatttgacactcataaaaaggttgagtttaattaataggtatttttttaatgttaaaattttctttttattgttaatcaatcaaaaataattattagtatataatatatatgatgattcatgattagatgatagtattaaatccctttacatacatatccatcaaatatgaagattaaaaaggtgcatgtactttagaaaatgagatatttttttagaagaaaatgaaatgttaattatttataataattaattataattaaacagttgagattataataaaaatatttaaaaaattcttctttctttatttctttttttttcttattacattatttatcatttgtttatctccttttttttttttaccaatatctctcctttctattactcaaattttcacaataaaatgggatagacgaagagattcatacatttttttgaacttgaactgtgaagtaaaataaattaatgagtagcgttatatctttttactgattttcctacaatttctcctattatttaataaagaaaccactaaataaaaagtaaagtattttatatctaataaaataaaataaacttaatacttatcataaataaaacagtaaaataatgctatgatatagtataaaattattcgaaattaaaataaagctcgttgcaaaaggactaagaaagagctgttctagcaagaaaaggacatgcaccttcaaattcatcgcgtcaactccgtaactccatatactgacggaggaaacatgtctaattaactttaatcatacaattattaatttatatttaatcatttagtttagttatacgattataaataatttagtgatgagaatgagatgataaacagggtggctctgctccagcacctggctgcagagggaggtgacgtggcctgcttggtggtttgacttattggcacattcatgtcatataacaaatacatatattataaccgcttcattaaagtcttcagcatttgcaaatccatattatgcatgttataccaaaactacaaatatactcattcgtgtattgggctggagtttaatgaattagaaatacataataaccaacaattaacaaagctgtcttcacagatcagcccttcttcattcaagaaatgcaccataccacctgcagacagtattctatataagatttttgataaatttctttaaaaatacttctaaaaaaaaaattagatgaatttttcataaataaaaataagttttccattagctaacttttagaaactcatcaatatagtttctctaaaagatgagatgacatatacaaattaattaatggaaaactcattttaccttatggaaaagttcattttattttttttcttcttattttctttttctagaaatacttctagataagtttacacccaaacaggtccatactcgagcagatctagacgaatgaggatttaattaattcatatttttgtcattttgagttacaagggagatgtggctttgagaccttttcttccttctcccctggaggaaattttgaattgatttctttatggaaaggcctggcgagacatgtatcaatagtgcttcagaatgcaagccggtagtgctttcctccatttcttgacttgctaaccatattatcattcttgcctgcatatatatatttttatagtattaaatcatgagtttaatggtgatgtaagaccatctaatcacaaaaaattaccatcgttgatataatcttttagataattttataaaattcaacaaacttatcatatatgattaattataattagatgattgtattttacactatcaatgcataatctgttttctattagttatttagttttataagcgttaatttaatttgacacatctaattatttccttccatcaaaattgtgtaattattttatcttattaatttcttttaaattcacaagcttgcttctcccattttgtgagctaaatgctgatttccagttttggagaaaaagataaggcataatcccttcttttatttcatctatttaatgtttcaagaaattctttcataccttcaaaattgacgtattattttctctctctaaatttaccggtatcaataaggggaaataaagtatttcaagaaaggacaactcagttaaataaacttattttttaattaggacaatttaataaaaaataaaaaataattttaaattcttaactaatgttcaagggatacaagattacaattaaaaacagttatatttttttaccaagaaaaaggcattatatctattaatccttatttcagttttatgaattgcttaattaaaaaatttacattcattaactaattcatccgttacttttttagtaataaattatagaagatatattattttaattatttcaataaaaacaatatagtggaataaacatttttttatacttataatcgaatttatataatttgattagatcttataaaataaccttttaaaagataaataaaattgcatgaagagaataatgatgcaaaattttattatgctatcaagtacagtcttgtttggtaacgcttaaaattgaataaataattacttagtttttaataagaataataagaataagcaattattcatttaaaataagttaaaggaaacattcaccgagtctgcagttcttggaatgcaataaaaaaaaaaatggtttaaaaaggagttaaaatggaaagatagaagattggaagatactataacgtatacctgaagttctgctgtgtcaaaaatgcattggcgtcgtccattatgaagaatagctacaagtttattgtggatgttcaacgtcccattcctgcaaaaatcttgcagaaaaggagggagaattagcaaataacgtaagaagaattccacttgcttaattcctgagatatacaaatgaagggagtcataacgtaaatattgaaaagaaagagtccagattgcttgcattgaacgatgggaaggtgatgaagacggaagacgaagatccaaatagcagtttctcttcatgtattaatttgaaaaatgaaaaatggaactattttgtaatgggtaacaaaagatatggcaattaatttgaaaatattggagaactcaattaaaaaacacagggagttgattacgggaagggtgttatatacaaacatagatgaaaaaatatgtttggggatgtgggaaatgagttacacatgcccaaaactattcattatggttatagcaagctatagctcttatcagttgcgtacccgcggcattcaatgcaattactaactcaatctgtatttcatgtgccttcttaagttgacagctatcattgtttgctcttctaaagtacaaaattacccaaattggatatttggtcacttggtcgactttagttggttttactttctctgtgtaaccactcttattgcattatgcatctcttatactacgtgctctctctaatttctttcacgtgatagaattcatttcaaaaagacatgaatttatatatatataacaccctttcattcagctgcctatctatctctctgttggtcattttccactagtaacttctatgtactatttcatatcagcacggattattataagctattcgatgaggaccttaattaaatatgttaaatattatttcaattatttcgggcatatatttaataattccatcaacactaatagggtccttaattagtttttccgcacaaaacttccaattatttgttgaaaaattgactattgcatcagcaagatgaaaattgaccagcaaattgactgtgatcgtctttcaactaacttctgaactgattttttcaaaattagccttcaacataaaattaaaaaaaaaaaaaaaaaaaaaaaaaaaggcaatctgagagttataatatttatatttcttttttctacaatatcttttacaactcttttcctccaaattctttttatcacattatctatctcacgtttctcgtataataagaaaagttgtataaatttgaactagaaacctaatttcttaaaatctaaccggatcaaagagtactacacacttagattgttctcatgtgtcacatgccacgtgtgagatgtttttatttttaattttttaattttaagaagacgtgtgtggttgttctacccagaaagagcaagatatatctaagaaatcatgcgcttcagttcataggcctaatatgccaagattgttttgagccaatgggacataagaatatgtagcaaaatgaattttaaccaattgacgactgtaaagtgatttattttgaaaagaatgttgacattttcatgtaattatgtaaaaaaacaagtagaaaagggtaaatagtaataaaaaaatgaatggtaaaaaataaaatgaaaaaatgaagaaggaagagtaaagagtaaaagatgaggaccaaacacccaatccctctgagatggacgcggatactacattatccagtgcaaatttttttttcgcaagttccataagtgattaaaaagagcatcaatcacatacaactgtgcaaaggcacaggcacaggcacatccgtacatgcagaatgcattcaccccaagtgtaatcctttatcgatgataaattcctaactaacactcactggtggaaatggtgttcacaccttttcatacttacctccaattccaaacctggttggcctacttcataatcttcaaagcaagcacatggtttaagcattttgtcttttcagttaaagccacttcctagaggccgacccctgattctgaactaatctttttttgacagagattctgaactaatcttaagaggccaacatcacaacttattgatcaaaagaggcaacatatgtttatacctctgatgagctcaccctgctatgctgaactgttttccctccctcttgcttaataagaggaccagtacattcaaaaacgggatttttttctttctaatgtcatcaagcattagatcatagtctgtgctttaatttggacttcactcgtgttttcttgcattgcaatttaaaagagcattatcctacttctataaaataaatttaaatcttcacatatgttccaaaaaaacaatttaattctacacaaaataacttttataccattattctttttcagttaatcatgtgtttccttcaattaatgacacgtcttttaagttttttcataatatatgttaaattattattgttcttaaagtaattatgtaattaaaacgtttttttttttattttctttaataatactcactctccataccaacttctcacttacagaatatttttggcccataaatgagtttgatcgaagctggctaggtcggttttatactagtgtttaaagttggctatgttctttgagtataggttttgattatcatttcctgtttgtttgatgtctgcagctgtcttctttttgtatgatccgtcacctatcacttccacaatcaaagaagagcaaggcacttttcttcatttcattactcgactttgtgcagttctaggtgaaacctttgccctaacaagattttgtcttcaccaattatccaccattttgccatatcaaaagtgaattgtcctctgaaaggttgagatgtggttattttctttgtaagaaatggttaagttggaactgcaacatattttttgtgcttgtaattagataattcaactgcagtttggcactttgaataagaattaaagatattgcgactaaatttccctaaattggtttttccattgtccttattctaaaagtgaactacggtatatatatttccggcaactcccctgcatctgtaagatttagaagctaagaaggactccctccattaaaaggatggtggcatagatgaaaattattcttttcatctcttccacagatttgtgtttgtataattccatgtattgcgggacattaatggctagcagttcataatctcctttgcttttggaaagggtatttaggggctctccttcgcattacattgcatggttttgtcatagctacgtgcatgtggaatcaatttctcatagttttgcccttccatttcccaattttataaatttaaaccgcaactggctaactgaaattcatgcactctatctaggacaccttaaactgtaacaacttttcctttttattcatgcactctaacaaatcgccggtagtaacttgagggtgttttcattaatggggttgaattagtcgatgggattgcttgtcagtgaaaggaaagagcataacatacaaaagtaacgtttaactatgttaacaaatatcatgattcacaccttcaagtggaaatcctcatgtttttagtgtaaaaagttagtaaaaaaagaaagaaaaggaacaagtcttcataaccgaggaagactgccctgaatcagtcgcatcaactgttgccatgctgcggcagatgattctcttgttgtctttgtcgctgatgatgtcctccatcttcctgtacctgttcttgtacatgctcacgatgctgctgctctgtccagttaacattttcaaaggaggattgaacctgcctgctagttctccatccgatgaattccataacgagagaattcatactgatggcaatcccaaatccagtgaacgaggaaaggagaatggagagaattgcattaaaattgagctacaaaattgaaaaaaaggtaaatgtcaaaatatatatttttgctctcaccgagtgccaagtatcttcatgaagtcaggataggaactatatcatcttacaatagtataaaatacatgagctaacaggataagagttgcaaactggaagcaagcataagcccatacgaaactcctgctcactgccaccacaacaacatcactcatgttaatcagaaactaataatccagtatcatgtagtctacagcataggattatagcaactccagaggatctaatgaacaggtaaattacagagtatgggccttgttctaatcaattctcgtgtcagaatcattaggataatgtcaacttcttttaccatttatttgttttaaatcagacattacacaccaaatcagatgttgcggctgatagaaattgtttctttgaactcactaaacttaaaatgaacaggaaaattacagagtatgggtcttgttctcatgaattctcatgtcagaaacaataggacaatgtcaacttgtttcaccactttattcgttttaaatcagatattacacaccaaatcagatgttgcagctgatagaaattgttcctttgaactcagcagacttaaccgtatactccatttgccaaaacccaaacaaactttgtttcttttaactcacctgacttaactgtatcccccaatttgccaaaacccacacataatctggttcgaaatcaaagtccaagatttacatttaattacacatatcaagatccagtacaggggtaacaaccatgcattaactaaagagaactttgaactgtagccatccacccacagtaggacaacaacatcaatgcttttttccacaggactttacagaagaaaactcagggaggagggaggaggaagaggaggatatggatcagcaccatttagagctagaacctttataaagttttcttaggtctccatccactccttttaattggactaccttccatttgatatttttgtcactaaggctcctactgctctttaaattaaaattatttaacaatgttggcttctcccttagcttaaaaactattattatagaaccctggcccgttataaaagcaaatggaagtcaaaacgtcagatgttaaagggaaagcttctgtgttctggatcctcccagtttgttaaagcttacaaaaatgattctgcagtataagtttttgggggggcatttttcataagctgctattttcaacctatgaaaaaagcagtaaaacagttttttaaaaacaaaacatacatataaaaatcttttacttaaaatatagtttatattcaaaaaaagaaaatgaaaaactcatataaacaagcaagaaatacttgaaaaatgcttattctcccatttttttgggggtacaggaatgcttattcttccttgataaactagagttagacgcttagtaattacagtcgtaatgagggtaattctaaatagagaaatgaggtgtacagaccttgtaacttatctcaattcttttggtggtaggaaaagcgcacataaggaatgacatttgcaggtctagtgaggagagacattaaaaaataattccaggccaatggaggccaaaacatttgatttagattttataagaacttacttattagtccaatatttgtcaattacaatgcattgttacttgttagtccaatatttgtcaatttccattgcatgtattccattttaatacttcatgattatttttaccgttatccttatctgtaaccatagcttgcaagtgcataataacctacttgatgaattccagcaacacactttccaatacactttgtaccacgtattaaaattcacgcgagtcttagtaaataaaaaatgggactcattaaataggagatgaagcctacatgaatatcatccaatagaaggaagtgtcttcaaaagagtataaagagcatattgctaacatctctctaacttaccataaatttgacaattatacatgaatatagttcacttttatacctcataataaaaaataaaaaaaatccagaataaaaatgaaatcaaaagtgcaaatgttaagaaagagagaagaaaacagcttacccatggttgatgcaatcatagatgaaaggagacctaaaacacaggagaatggtaatgaaatggcaagagcacgaggtcccaaatctgaaacctggtaaactagaaaccattgtgtcagacacacttatatttcatacaaaacagtagttataaagttggcttggtggttaaagggagaaggggggagggagaggttgtgggttcaaatccctcccactaacaaaaactaacaaactaacaactaacagttaattgttaacaaaggaaaacaaaactagaaaaaataaatgaagcatatacagcattatccaagggctctcatataaacagtattagtaaacatggccttctagtactaaataggcaaagaaatagtatctccctttattccccagaacacaggtacaaaaatgtattccatgaataaattaatgagtaaattgaacaaaataataaaatacaaagaaagccatttgtttaaatttggacctacaaactgcctaaattataaagcacttttcccactccttcagcactaattttaaacttaaaacaagtgatcttttgcctttttaagatacagataggatttgcttcttacaaaaaacagaaaactatttttatttttttaagaaaaagcaatttagagaaacacaaaaaaagcatacgactgcttattttattaaaaaaatattttttttaaaataacttttaacaaatgggccctaagtatgtgttccctgttcttatgccctaaataaaataaaataaaatccttcatctgtaaactgagaaaatcgctatactcccagtagatgaggttatattttcagaattacatactaacaactacagattggtcaaaataatctttcagaggcaagtttctcatgtagatggcactgtaacaattggatgcaataagcccaaaatcataacttgatgtaagcagcagttagccagttaccataaacttcagcacagatacaaagaaaaacataccagtagttgctctagaaaacaaaagtacgcaagcatgctgaccaagataagtactggtacatcctgccagatcctgttatgcatgaaatagatagaatacattacaattagaaaagtagtgattggctgatgatttatcataggttttgtagacataagaagggtgatgtttatgtctttttaggaggggtatcttaggtagatatacaaagagattgtaatgtgttacattacatgtatcatgttcttagtttttctctttattccctttcatttttggtttagtttttcaggatttatttattatcctctaggttttgacatgtctttttttattaaatgattctttgtttatccaaaaaaaaaaaagcagatgtatatgttgttcaaaatcagaatcaactgcatgtctattagacagcccatcagccaatagcttatggagtaggcttttcagtgtgtttgatgggccttggattttcccccataaccaggaacagtttcttgagattaattcaaaaaatttggcaggagcagagggtaaagttttacaggtgtcttgtacactgtcatttgggtcttaggatggagaagagatgcttggttattcaaggtaaatatcattcaacttgatgtagaacattattgttctgatggcatcttattggagttcagcacatcgattcttccaagggggttgcttagacggatataaaaagggattggatagctctcttattttctttggtaaagtgaaagaaggaaatctattctttgtaatcttttccttatattctttcttttccttaaaaggaacaaaaaggatgccaaacaataccaagaggcaagagcacatcttactgccacagtgccacctacccatatgtgcaaataaactgaaactgaagctttttaaacttaacaacccaaaatagttaagatctactactttatatagttttataaccagcctggttgccctaatatcatatcatagataacactttaagtctcctctatgtcagtttaagtgttaattgaacacagatgactaacacagtgaagtaattaaacatacctgtaataaactatttctgactgttgtggcacatttgatgcctgcctagcaagagtttgaggattataaattttcaacagtgttactgggaggttctggacatcctgcttgcagacatcacaggtcctgtttcccttaatactaaaccactttactgcacattcttggtgagcaagtgcaagatcacctttacaactgcattccatcttaagtgtattccctccttccccaagctccaccaaacaaatcctgcaaactgcttgttcctctggaatatcctcagtagcatcttcaatggctggaaaggaaagaacagagtgaaaagacacaaaggagggggaggaggagggatttaagcattcggttaacaagataatacaagccaatgagaacagtatactgattaaaaaatttatgtattctatgaaaaattctagtccctatttaacctgtttctatttaaataccaagtaatcctaactcagaaaaagacaaaccataaactaaaaccctaagatcaaaattgagaatcaaaattagaagttaacatcaatataaacttcattcagtattatcatttctttatttaatttggagagtccactgcaatgaaatgaaagggttttctttagattatctctaggaaacctctattctctttcttctatattattgttgctaatttcatttaatttatggtttagtgctcaactcaataataaatacatgttgcttgtcaaaatgacagaacatttcaaattatgcacattgttgatcaagttcaagaagtttaaaagggacatttagaagaaaattttgtaaattccatatattgaggaattaccaatctctggaaggaaagcaccatcagttaactttccaccaacagtttcaagatgtcgttttgccgaaattacacgaatcaagcccctagaatctgtaacccttaaattagtggctctgccattaactgggactgaaaatgatcgtgtcatatgctgatgaacttccattgtctgttcaaaaagaaaaggcatatattaagcaacatgtgccatttttcacttacaaaatgtgaataataagtacagtgtaaaagtagttgttttggtcttgaaactagaatgaacactggaaacatacacttaaatcagaatcacgtcctagatgtcttccatgtccattctctacacctgaagttgcaaatggagtaactggtaatgaatgtgaaacttttgttaatggggagataaccctattattaagagacagaggagttgaagtggaaggtttgtccaaaggagcatctgatgggggagtgttaggaactatgagacctgtcctttcaatatcctgggaacaggtatttatcttgaagctcctatgaggaagtaaacctctcattgaagacctgactttggctgaatttggccttggggggagtcctcttgtggaaccaggacttgatcgtgaaaccaaaggaccatcagtctttgcaaaagtagataatgcaatatctagggaccatgctggtatttgcagtgaggataaattaggtcgtctggactgaggaatctgggagtccttgttactcttttcatttccagtacatgtctacaatgccatgccatcaaagtaaaaaattcagagctggacatgtttgtattccttttatgatggcatggtgtgataactaataattactttagtctatccagttaatctaaatactaaaacattagtaatctaattctaatcaattggttaaaaaatacagattattggcactgccacacccagacccccacaaaaaataaaaacaagatcttgaatgaaaagaaagcacagaattaatttagtagtcacattacgattattcagatcaaaacaaacccagggtttcatttctttaagaaaatatttagagtaacctggacaggaaccggcacaaaatcggcatcaagttgaagctcagcatcagcaccgtcacctctcttttccatccaaggaaacgctttggcaaaactgttacagtcacggcatcaaatgcccaaacgccataatgtgttatattatatttttatttttatttaattatgattagcattataataatagaagggaaagaggggtgacaatgatgatactgatccgaacaaaggttagggttcctttgattcagataattaattttttaattaaccaaaatcgaaagattattcgcttttttggaatagttatctcacgattattacccgccaactgcaactcgtgacatgccaactttatgatccttccacttctcccacgattctccattctacgtttttcctctttccttcctctgcacctcgctcacacacacttttcttggagtcttcagcctctcaattttttgcaatttttttcctcttttttatattgtttcaaccataatttttttataaaaaaaaaaacataaataaaacgccagtttcctatattttttttattaaatgtaagggctggttttgacctactaaatgtgaaaaactctttttgaaaaataaaatatttatatatctttatattgtaatgtaataaatatttttaataaaaaatattgcttttaatttttaaatacttaaaattaaacggatattaacaaaattgtattttatgtaatttcaaaatattaaagttaagccacatgaaaacaccttcaatataggtcaattgttatttccatatcaaacttataaaagaggtaatgagtcactatagtggtatgacttttttatttaagattttaattaagattaatttaaaattatccttgagatctatgcttaacacaatacatacaatttgaaggatgttttttcggaaagatttgaaagtcattccgttggattcaaggttgatttgatgattgtaggaagaaaaaaaatgtttaaactcatatactaacaaaagaaaattgaaattgtaatttagcattttttataataataaaggttaacttatattttttatctactataatggttatttcttaaatctaatctcttgttttcttttaaattgtacaaaaatgggttaatttagataagttcacataagcatgtggctaataaggtgaattttcaggtacttaaaataattaaacttatttttaatttttactatattaacaaagttatttttacaagttatagaccattggtctacaagctcataaattgtgtggctaattaggttgttacaccttcaattatcgtttcatgtcccattgtattttaaaaagtacaacatgaaatgtaaaattatattccaaaatgcaatgggggacaagaagaaataattagaggtgcagaaagttttagccttagaagtagacaatagttaaatggatgacttgtgtttaagctgaaatgcagaattgtaggccttttcacccccatctggcgagttaaattttattttgaagaaaatggttaatcaattgaggtgattgaggaatataaatatataattgtaagaagagttaaagaatgaaggcaattaaaggaaggtggtaagcaggtggtagaataatgaagcataaagtgaaatattttgatgtttagcgtggaagggaagttgaggaaggtagaggggagtttcttgtatgtagaagttggattagaatttgaagtccagtccactgaattgaaggaagagcccaagtcagccacaaccacaaccacagaagaagtcgcagatacttgacagtgtgtgtgtgtgtgtgtcattcaatattcaatatttcatcccaaagactgcttcctggatgcatcctcaaagaaacacacatgactcatgactcgccaaacaatccacatacatccccccttccctcaatcacacctcattataacatcatcctactcttccctaattaaactccaacattctaaatgatatcaatattttcatttattagtatctcccgtaaatatttaaatgatacacacctatattatatctcatcgatctcatatataatcacactatctcagtaaaaagaagtcatttaatcataataatttgtgtaattaattattttcttaaaatatatgcggtgccgaaatttatttttctattaaatagataaagtttatatgtaaaacatataaaattaaaagttcagaatacaataacaacatttttttattcactacatgaatcacatgttattattgatttccattaaaaaccaaattacgaagaatattatttatgatgactttctatctccatgaagtccttttgatatactactaaaaccatccggtcttgtttcctgtaaactcaccaaaccatcttgaaaaattcagtgtctgcaaaagaaaaaaggttttttttttctttctattaattaaatattattgtctgacacatgaacacgtggtcagtaaatgaagggcgaggatattgcattgcgtttgtaactatgacttatgagttatgacaaggaccaaggtgagcacagtgaagaaggaaccataaataggccaccaatgcacatttttcttcccatgtcattctcattccctccatgagtgctaccatgtctggccctattcctaatgatcactggctccatttctatcaacaaaaccaattcccctcttccgtttccgacgccacaaccgtgacaaccaccgccgcgccggcccagctaagcccagaaggcggagtctcaaagcccattagacggcgttcccgggcctcaaggcgaactcccaccactctgctgaacacggacaccaccaatttccgggccatggtgcaacagttcactggagccccttctgcgcctgatctgtttgggcagccaatccctgtgaacccaaatggcctcatgttggccccttctcagtccctttatcagcaacaaaaccacttagcatacacagatggtggagacaacggtttttttcagagactgagcaacccaacagcaacagctccaaataatgatcgtgctgatgaggttttcgtggaccatggcggccgtttcttcccaacaacttcttcttgaatctttcttgtctgtccaataggaaggagcttttaagtttcttccgacagcgataaattaagcagatatttaggtgctaacttcttgaccaaccctatgtgaaatggaactatatttccagtgtagacagccacctgcacctgtaccacactttttcagctctatcttattttttggccttccttggttgaaatcgaatccagctatgttctttttttctttttctgaatttatgctgtgtcggcgttggcttaagcttttgtttgttttccttttctatttaaatttgtgtatttgttttctatgttaatcttaattgggaccttctctttagggagtcctagcccgattatagttcaattattttggatatggtaactcggtcaggcctgccactacctacaaattcttttacgtgtgttgacttgcttccttctttatatctctctctgtaacaacgttattcacacaataaattttataataatttattttttttatcaaattacttattttattccaaaaatatcaaatcacttatatgatcttttatcttatttttagtttaatttgatcatttgtttttttaaatataatttgatttttttagttcgctttagttaaaaattggttatttatcttaattttttgtttcaattttaaaccaactttttttgttaaaaatgaagtgaaggaaaaagggagaaaattgaaaaaaaaatcattttaaatgataaataaagttaatcttaaataaattaaagatcaaattgaaaagaaaaaaagataaaagatcaaactgaacaaaataataaaataaaaaatcaaattgaaccaaaaaataaaataaatgaataaataatttttttaaaagatagaagactaaaatgagctttgttaaaagataaatgaccaaattgaaataaataaataaaaagataaatgatcaaataagtcatttaatcttaaaaatgattgttggacactaattaaattattagacacctataagaaagtgatacaaaaaatatatagatatgatatgataaaaagagaaatgatgagtgtcaataacatatattaaatgaattctttgataagagttgacaaaattgattttaaataaaattaattttgattaaaagtgattttgaagtgatatgattaatgtttaaatatttttattttaaatttaagttaaaagtaaaatttagtataattttttattcaatacaaaaattactcaaagttaattcaactcgatgcatatctgcttcaacattatgttgaacttgatccacgtaaacttatggacacaaatttagcatactactcaatcaagtttggattcaaaatcaattataaaaaaaattcaacatgaaaactaaacatgtgaaaaaatacctaaaatcaattatggactcaaaattaatttttaatgtaaaactaaacatgcactaaatgaaatactgtccaaataccattttctattttattatatacttttttattatctcttttgcatgaaagttaatataaatttgtattatatataaatagcattcattatctctctggcctttggtaacgaaaaatgtggaagcaggaagcagccctctctttataatagtaaaatctccatggtgtggaaaaaataaatttatttgaaattaagtagctgttaacaagtgtgtttggacctatttcatctttgagtttaggatgagtcaaacattatttttcagttgacgatgatgtttgatataagaggagtgttaacgacattttttttttgtaatttgttaaaatttattgaaaatcacttattttgataaattttacttcttaattaatgtttctctttcctaaatttattgaaaatttataattttcaataaaatctaaaaagagtgtcactatcttgaattgtgtttcaaattcaagtttaattggaagcaattgaaagtatttttttttttttttgtatgaacactatcttgaattgtgttattttaaacattacatgtcaaaatcaattttcaaatatacgcggaaaaaaatcatacgactgatcttacattaacttaaaatcaattttataaaatcacatgattcaaactaattctaaagacatatatccaattcatgtatgatgcctacaatatgcaaaagatataattgatgacttcaatgggacatgaaaattcacgttagattgtacgagtaagttgtgattttccttcccggagctagcaacgctgaaaaagaaagtagaacccgaaattaagtgaataaaaaggatatggtatttttcccatctaaaattaagcatatgcacaaacaacactttcttgtataccagcattcaacacgcaaaattttgaccacaccagcaaaatgaaagttcccttgtgcaacttcaaatccactatccaacataatgcatataatattacagatatcgcacggacagttgctattgacattctgccgagaacccaacaactccaccgaagtatacctattcttttttctcatctcttccattattttgaggattaagctcatcatcatcataatattcttcaaaatattcttcatcactatcatcctcctcatcataataatactcctcatcatcgtcgtccttatcatccttgccattttgtagacgaagtgtgccatctcttgactgctgacctcttaacctctcttgaattcgatccctaattgctgttccctgtttgtagatccaagtggtaacaataaataaaaaatgagaagttaacaagaagtttacatacattagaagagttgcatagctttttcacataaattagctcaccatcttgtggcaaccttcttcaaacatttccagaaaaccagctacccaacgatcagcattttccacccactcattccgatgcataccagcagtctttgcaacaatttggatctggataaaccacacaaagatatgtatctttaccataattgataattcaattaaaaacaaccgagataatttcaatgtatgatactgttatatattaagtattaagcgtacataaaagttgaaaagagaatacttatgtccacttattatgtaaaaagcataggttttaaaccatagcctcatctatactgctatatacaaagcaaaaaccgtagattagtttcatcactttcaatttaatacaacatctccctcacaccccgatatacattagcaaaatcaataatttaagaaagctgcttcctaataaataaataaataaaaaactacgtaccccaatatccgaaggctccaccctatgtgcaagtaagagggagggatattgtatgcagtcttacccttgcatatgcaaagaagttgtttccggattcgaccccataaccaacaagtcaccaagacacaacttttcttaaagacaaactcagaaagagagagagatgcaaaaatagtatcatttctctatttttcttttacaagacaactacaataaagccagtccatagtttttttcactctctagtatcttttccgtgtaggcaaagaattttaatgttggccaaatattaatatgagcctaataaagtcaaggaaaaaaattgaaacaagaaatatttggaatcagatgtatagctgacaatagagaattatgccaaagcaaactagtaactgactgatatcagtttcatggcaataaatcatacaaccactaattaccagtgaaactgtgatctgtgatgcccgacagtgaaggtttgacaaaaaaatggggagaaattaaaagcaatattttctcattcatccaggtttgtcacactaaaattacaatgataagttaaaactatattgaaaaaaatatatagatataaatttaagaaaaataagaaattcaatctgcaaagttctctctccccccccccctccacccacccacccacccacccttctctaattacacaatagtaatcaaacagcaagaagatccatgaagccaatacatttacttaaatataaaaatatacagaggatatgaaaacaaagacctatatatataatgaaatttagcacaatatgaggaatgcaattttcgagaaggtatattcaattgatttgataatgttaggactccatgattccgaattaaaacagactgcatggttcaaaataacaattaaaacaacatagccatatgtcaattcagattgggttggtttttttgttgattttactccttgataatgtttttgtccttgaaaaagactccgagatccacaaatgcaatacttagacaaaattgtgaagataaaccgttgaatccaaaaaccagtagcagatgcccaatgtcccataacagtttgaatgacaattgtacttaactatgaatttttcaaagcactttacctgacattcttagctcctacttcaacagtcgttacattacaaatttacaatctacatgtgattttcatcctacagccctttcatcccatttaattcacatgatgttgcctaacaaaagtattaattcgacttgattacctaaattatatgttatagcaatacataccttttcgccaactttttcttgatgttccttcactttctcttgtaatgttttcaaccttctattcaccctcagtcgcttttcctatttatgacaaagtaatgacaaccacaagggacaagagcattcaccaaaggaacaaagagtggcgtcaatataaggtcaaacaatttgctgaaagacgtatcatgttaaattttaaagtagaatacatcaaagagatctatgtcaaatcatgccttcacatagctcacgccaagctcgtttcttgagtacccacgatccaagttccgcagcacatattggttataatctttgacaattctcattataacatctgacgtggatattccttcggtccgttttgtttccttaaacctcccaacagatttaacctacatacaaaattcacggcacatagtataagtcagaggagaaagtaacaacgaaataaaaaaataaaaaaagttttgccatacatacaaattcataaacatcattggcagcaccactggcatcagcataactgtggacaacgggttgacaaggggaaaaaagatgattatattatgcaatgaagttactagattcagatgttgatgttgagagattaatcttacggaagagagtcatgagccacataatcaatgttgttcttgtcaagaaactcttgattgataacccaaggggcatcaggaataacttcatccacccatctgatctcaaaatgaaatcaaactcaaattcaaattcaaattcaaatggttgaagcaacaacaacaaacaaaatatcatacttgcagtggcgcagggattcgtatcgttcggcctctgtcataacagttttgcctttgtatttgtgggtgacttcatcgttgcaacacccaacaagcaagtatgtattcggaaacctaaaatcccaaagtaagagtgtctgtgaatggaaccttgaagaaatgacttctattaattaatggattgatataaatgaaatctattatcagatctcggaggcaaagcgaaggatcaaatatcatatgaggattaggaaatgattgatgcatacgatttcttggcttgctcaagggagcgagcgtggccaaagtggaagagatcgtagatgccatccgcgtacacccgaacgggacgctcctgctcctccggaggcgacgccgttttcgaatgctcgctctgatctgccattcgcctcttctattctcttctccttcgctccgcctctctttttttcttctctttggtaataaataaatcgcaatttcgctcgcaaacgtcctatgcgctttttcttcactgttttcctccgaaatgttctttttcttaaaacgaagacgaagaagagtactaaacgattgtttcagagtaaactatgtttttctcttataaaaaatgctttttcattttcatgattttgttccttcaactttttaaagacttcgttcttcaacaatttttattgatatcaaaataggccgaatctggtgagccataagtaagttatgttttctaaactcagcatatttttaatatattcagtatattttttatttacaattttatccttatacggattatcaatctgtataaatcatatggattgattatcaatataactcatacgaattggtaattcgtagtcatacagattgtcaattcgtaaacattcaacacaaacggatgagaaaaaactcaaggcagagaagacaaaaatcaatgaaagcaacgacgaatgacgaaatagcagacgaaccacgacgttgggtgcacgaacgaatggtgaaggtggagaagaaggagaacattgcgcaaacaaaaacagacaagaggagaagaagaaaaagctaaatggtgtatgtccatttttacaaagggtatttttgaaaattaactgtacaatgctaaatgtattgaaaatatgctgggtgtagaaagcataacccgcctagatgaaaaattaattttttttgcaatgtgatgaaattgtaattcggctcacttaacccatgatgtttagacaattgaatttgattttaagactttggtattgtaagatttttgaatgatatttaggaatttaagacatttgaattattacttgaatgataatattatatgtttgaatgattatttgagacatttgcctattatttgcattcgtatttgaaccatttgaattaataaatgtcgttgatgaaaaaattattttaaaaaaatgaaaaatgttataattttttatttagaatttactttttatttttataaatttggtgagtcaacctatctaatccattaattcatagtgaatcatgtcaagttgatattttcatgactcatttaaatatgagttaaattaattcggttatttaacactcaacttatgatagatcaatctatattcatcacacttatttgacacttctactttttttatttccaatgtttagatcattttcatttattccatagttaaatgatgatatgttatttatttttattataattcattttttggcaactcaaacgctaggataactttttaaagattataaacatattctatgggcaagaaattcttatatctcaaatccaaatccaacatttatacaatttcaaatccagattgaaagtttgaaacacaaaaataaaataaaaacaattcttcaccacttctaaactttttctccctatctttactcccaattcttcacaacttcacttctccctctcgtcctacccctctcctcctaccaccatcgtttttcttatttttttatttatttactagttaaagatgttaaaataaagaaaatcctaaaaatatttcaaaaatctagaacaaataagaaaaacacaaaattcacattttttttattcttcactcaagaagtgttctcatccgccactggtatcacgttggcgtatcccacatcatcaattacttttattattataaaaatgaagattttatagtaatttaattaccataattgaggatgagtttgtttaaattttaaaaataacaactttaaaattggtatttaaaaaaaaatctaaaacttaactaatttttttatctttatattaatattctaattattcgtatacttatcataattccttgataacaattaacttataattactgctatcatgatttaattatttataatttcaaattaaattgataataattaatctaaggttaatagctgcacaggtcttcttgtttgggaatgttttggttggcagtttctttctcaaaagttttttctgatgttattctatatgaatttggttttcaggattcattggtggagactgctcaagaggaaaccagttcattaagtaatataattgcgcaaaccactaagtgatgagatcctattatatagggtttgtttggattggtgttagttccatccaacaccaatcttttgatactgccatcccgttgaatgtgcatcggaatgtacgatttcagtaaaacaaacacactcatagttgttgccattttttttgggcatgatgcttggtgtgattgatggacttttcctgttatatagtttatgtctaagccccatttttattgctgttacgttgaatgttcgattttttatctccttgattctttcttttttgttttttgtacaatagaaaagaaaaacataaactaagttttaacaggaaattttgatcttcttgatctgaattccattttctgaaggttggcaatttcaggtttgtgtacgcgtgaccgacctgtctattactggtaatctgtatgtttgaggaatacttttgctttgtactttgaaattgaaatcctgtgcttgtcaatttaatcttttgtttttgagttgttagtcttgaatgatgactgcataatatatgcatttggatcacagcgacaattcaaaaaatatatttttttaaatggaagtagcaattgttagtttttagattaatgtgatgtatattttttaaggtagagatctgtacagcgtcagtaagttaaatttagattataataatttttgttgtaaaataaaaaaatgtttaaggaatgttggtcaatttaggtgttggcgtagaaggggttcggctttgttacctagtgtaatttattatattgggtaatagtatttgtacatcataatatttgacattattttaataggtttttatggtaaatagttatttttgtttttaaaagtatgtgatgttaataaattagtattagtcagttcgcttatatggcatgtaaggatgaaagtgtcacgaaagaattatcacgtggacatagagactaatttgttagtaatgattttttttattgcttctccttttgattgttagacttgcaatgactatttttttccctctatcttatatattgttctccaagaatgaaggactgagcttcttgttcttcctctctaggtgtttttttttttttatctcaccttcattcatttaagttactgacaaatacgtcattaaattaaataatttattgacatttttgtctttctaagatatacaaaaacgacagcttcgtcttcagtggaggaagaatggtgctccttcacggtagtcatggaagtcgtcagaagtctcaaaaggcgagaaggggaaggtgaaaagagaaaatgtaacaaattaagggtaaatgaccttgtgttttgagtttgactcaagtagtaacacaagaaaaaattatattgacattttagtcctacgagtcatcgtctcaggttcaaccaatgaatgtcatgtgagcaattatttcgtgacatttttgtccttacgagctacgtaggtgaattctctaatgttaatggatgaaagttgacggtggaatgaatttttctcacttttacattttcaggaactaacttttgtatttttaacattcaggaataaatttgttagcgctaaacacttttaaagataaaaatgataatttatccatatttttatttcatggaagaaaaatattaaaagaatatggtaaatatcattgtgattcttacatcagtcacaaaaattaatttttaacgaagaagtgtgttaataacattgttgttaaaaaaataaaaaagaatattataattaagatcatgtgtaaagcatattctgtttagttaactaatattctcttacgttttggaaagcgacttatactgtggttagtctagagtggaagcacaatctccacatatgtcaattcacgtgcagtccaaataacacttattgaggacagccaacgcacatgtccacatatgccaatgtcacaggctgataggtgatagcggttcatgataaaatgatgcgttccataagttgtttttttgttgacaccccaatcagcatagattttgatttagacatgcaatatttcccgacaaattcacgttctataaagaaaagaatttatttaatctccaaatattattatttcattacgtagtcacgaagatgaaggaagatggccgagtggtgttaatttattccttccttgccaagcttatgatcaaccgcgatgaccgtatctggatcagtgtgttgcagtgttggtaatgaaactatataccatttgacaccacaagtgctgcttacacgacaggtagccatgtatgaatatttctcctgatcatagtcacgaagatcataaaagatatttctcgaagccctctcctttcatcccggcgctggatttatatttaagaggaaaaaggaagaaaaacaatcaacaacagcatatgacatgcaatgtacttaatttcaattgaaaaaaaaatatatagtgaatacattagctacttaaacatgacagaaggcatccgtctaatttacatgtgatacaaaccatagattaaaatagcggcgttttagtgcgctatctcgcttcaacagcgggttgcggcacccagccgctacttctatgctgcaacgcgacggttttcggaggcggcgttgcgtgtggcagatcttgtggcactatcgcaccgctatttccatggaagagaaaaaattgcaaagctttagccatcggggggcagtgttttgaaaattaaagataggttaagggttgcagagaagacgagttgcagagctcctttgccgttgcctcgtcaaatccatacgctggcgccgtcggcccctcaccgcccgattgccgcgaccaagggagtaccacttgtcgcggtaggcgtcaatgagggcgagggtttcatcgggggaccagcacgacggagggagatggcgggaggagggtggtgcagggatggggacgagggcgaggggaacggcagtggggggatcgggaggagggggagaggaggccatgggagagagggttgagggaaagtgggtgtggcctatgggtatggatcgaggaagaacgaaagagaagataataatgcgatgaggcttatcactgacacaatattgagagaaagtgggtgtggcatgtgggttttggtaaatggtttatcattgcaatctccacttcctctgtcaatgtcaacactcatttttattcaccatttaaagcaaaatattttttcctattttttattcattttaatgttatactaaacatttttttaagagattaaataaaagtaatgtttataaacaagaaaattattatatagagaaataaatcttttaatatgaaggtacaattaaataaatattaataatatattaatattaataaaaaaaatatttttatttatttattttagagttaataagcttgtttattttaaaaattattaataatatatcaatattaataaaaaatataagtattatacttttcattcctcatttcttcctatttttgggtaatttcttaacttataacatttatatatgtaatataatttattataagtatttttaatagatttcacagtagcagttttaccgctacccgctataccgcttagcgtttttgaggtcgactgctactgacagctacccgctatttaaaactatgatacagactaaactggaaatgaaattctctaaaataggaccattgtgcatgaaaactggctggtctcgttttgtaagccaaataatgctaatgagatcctatcccacatgctttccaatatatctaccactacagttacaatgcttgaaaaataaaatcaaactatttgagaaaccgcctatcagaggaatgcttaggggtaagactcaataataatcatagttgcaagtttgccttataacaccacaattccaagagtcttgaataaatgcatcatcaacctcacagacttcttcatgagataacatctccactatcacacaaaacacttttgctcttaattgttcggtttcagttttatcaaacaagccccaagagttcaagactacagccaaattatgtaaaaaaggctgagctggagaattatacctcaatataacagtaatcatcacaccatttcttgtatcaggagtaaaaggtaggatgaaacttgtgacactattcaactgtacatgaattgaatgagttgttcatcactgaaagaagtgtttcaaatgaatgaacaataacagttctagtcatgtatgtgtacactggatgaacttatgctggtcgtgaaactatcattggttataatcaatcctatgactgctgtgtaacaacgaaccaaactcaattttttgaaagctgcccactgcagagcaaccaacagctcactttgataatatttgtcataacacattcatttcagtcactagattccaaaatcctatttaaattggaattgttgcgtggcttataaccagcatccttcatgtccatagtcaatttgtccaagatataatatatctcaccactttgagggtgcttctcacctctggatacaaagaagttcacatgcccagcaatctcaacccaactacatcccatttccttttgcaaacctttttccttcatctgatttctcacactatcaacattttcccactctccttcctctgcatagatatttgagagcaaaacatgatatccaccaatccttttatctgtttccatactaagcaacttttcagcaataaattttcccaattcaaagtacccatgatttctgcaagccccaagaatagatccccagatttctattgcattaccatcctcacccaatctctggacaaactcataggcttggaccaccctcccaaccctacctaacatgtctgcaacacaacaataatgttcaattgagggcttaattttatgtactttgtccatatactcaaatacgtgaagaccttcttcaaccaaaccactataactgcaagcagacaaaatggcaacaaaagtaactgcatcaggcttaatccaacatctcagcatcgaatcatacaaggcaacagcttccttacccattccatgctgaccatagctcattatcattgtggtgtatgtgacagaattcctctctggtgttctgataaaaacattttcggcataactgattgcacccaatttggaatacgtgtccactaaagcagttcccacaaaaacattttcgtccaagaaatgatgtatggcaaatccatgaagttgcctagcaaaggtcgtacttcccattgaactacaagctgggagaatcgaggctaaggtcactgcatttggtattaccttgtgaactaatgcctctctaagaatgagaatgactttgtcactgagcccgttctgtgtataaccagcaatcatagcattccatgtggccagatctctatcacttgggcagttctgctcaaataacaactcagaagtcctaatcaacctggatttcgcatacatatgaatcagataactctccataccctcaaactgtatcccgtggcgaattaggtatgcatgggtttgccttccaatgtaagagctcctcatgttggaagccgcagaaagaagggccatcatggtaacggaatcgattggaaacttctgcttctgcatctcgcacacaagcatgagtgcttcctcatccaaaccattctgtacgaaggaagaaattatagtattccacgaaacagcatccctttgagacatgttatcaaaaaccttaaaggaagtgtcaacaaaattgcatctggagtacataaccatgatagcattgacaacaataacgggagtaactgccaatttttttagaacaaatgcatgtagctgatgagccgatttaatttgctgcagcagcgaaagagcagagataacggacagaaaagtgacctcatcgcacacggcctcctctgactccagggctcgaacgaaaacatcaaccccttgaagaggacagttattttgaacataaccaccaatcatggtattccaaacctctgtattttttatggagcaacggtcaaaaaccatcctagcatagtctaagcaaccaagattagcaaacataacgattgcggagctaacagcaaagacgtcattgacatagtcagcaccaaatttaagaagcaaggcataaaacataagagcggttttaggatcagggacagcggggaagacattgacgaaagtaacgggcgacggagtaatggaagttttaatgagggttgcgaaggcgcgaagtgagtgaaggtgtctgtgggttttgacgaatcatgaaatcaaggtgttccaagcgacgacgtttcgtttgggttgggcataaaggagaaaactttgaggacgtagtcgtgttgggattgggggggcaagcaggaggagtacatgttcaagagggagttgtagacgattcgagagttggatggggagcgaagaaaatgggaatgaagggccttaccggcagtgaggttttgggttagggcgcaggccttgagggtggaagagaaggtgtagcaatcggaaggggtgtcgggggtggacttcatttcagcgtagagctggagggcttccaacggcatgtggttgcagatgaagccgatgatgacggtgttccacacagcggtggaggcgcgtggaagagtgtccagaagatggcgtgccacgtgaggttgtccctgttggcacagtttgcttaggcgagaccgaatgctaacgccgcggcttggctttccgccctcaacttgaacaggaggaacaggaacaaccgtagaagccatgaccctcatcctattgctatttccttttgttgtcacactcacatcattacctcttctatccatataattacagtaaaattgtcctactacttcatcaattctaattataggatcacaatagaatgtttataactactaaaagagaaatatattgtaattataaggataaaatggataataaacctaaacaaataagagtataataatcatacatccacaatgtaaaagtttttttttttttttttatattatcaaacaattaaaaatcattatcaatataacttttacaatgattattgtaaaatttaataaagttatcacacactattttattttattatttattgatttacttaaaaaaatattgacacccattagaatacatttgttatattttactccctccagacttaattaaaaaaggaaaaaaaaaaggattgatgaaagcaaattttaactatttgcatcctatttaataatatcatcttaaaaataatttttaattaattgaaattttaatcgaagattattttttattcttaatattaaattaaaaagacacttaaaaaatagtttttaaattttaatactaattccgatcctttacataaaaacaaatcataatatttttttcctaattatagaatgaaacatattattgttttgaaatgtattaataattgatatccttggtcttgatttattgtgaaatataatattgagatattattatttttgcgtgaaagtaaatgcatttatcaaactattaacattatatctcatactcattatttcttaaattattagtaatgttgttatatacaatcgtcactttaaactaattagttctataagcatatttaaaataaattttaaatttattaattaaaattaatttatctattttcatttattttgacgaattaaatattttttatttatttatagaactgaatgtattattaattaactaaaaataaattaattttgtttatatttgagtttgacaaaagtataagtaaaaaaaaatagaataaaaaacgtagtccaaacacttgaaaaggtaaaaacttaaaataaaaataattaaaaccatacctaaacatgtaaaaaaaatcatacctaaactaaaatattaaaattttaattattttcatcctccgttgattagtatcgagccccgagaaagtaggaaggagaagggtgtgtgactgtgtgacagtgtgagtgtgagaataaagaaaagaagagaagattgcatttgcatcaaattgaagaagatggaaatgcagcaactcctcagtatgggcttcccggacgagttagccgcccaagccttggctgccaccggcggcaaatccaccgtcaaagccaccgaatggattctctctcagaaacccaactcttccacattccagcccaagctcgatcgcttcttccattcccagtcacaatcacaagaacatgacgaaccctccaagcgccccaaaccttctccttctccttctccttctccaccacaaccacaacactcgccctctttcttctttaagatcgcagacaagaaacacgccaacagccacattcacgaacccttgtacgagcggttgcgtcccagaacccttgacgacgtcgtaggtcaggagcatctcctcgctcccaactcccttcttcgctccgcaatccaacgcaaccgcctcccctccatcctcctctggggcccacccggcaccggcaagaccactatcgccaaagccatcgtcaactccaccccttctattaactcttaccgcttcgtctccttatctgccgtcaccagcggcgtcaaagacgtcagggacgccgtcgacgaggccagaaaactcagactcaaatccaaccaacccaccgttctcttcgtggacgaggttcacaggttcaacaagtcccaacaggactctttcttacccgtcattgaagatggcagcattgtcttccttggggccaccaccgaaaacccttctttccatttgatcacccctctcttgtctcgttgccgcgtactcactcttaaccctctccaaccccatcaccttgccttgcttctaaaccgcgctgtcactcacactgaccaagggttgatgcagagcgtgggggttcatgttgatgtgagcgaggaagttgttgatttcataagcaacaactgtgatggggatgctcgggtggccttgaatgccttggagattgcagctgttaccgcggctgcaaggctacaacaagggatggaattggatcttcacacgaacgaggaatgcaaggatgctgctgctgctgctgctgctgctgttgttgttagtgttgctgatgcaaaggaggcacttcagtgcaagcatgttgcttatgataaagctggggaagagcactataatgtaatcagtgcgttgcacaagtctatgaggggaagtgatgcaaatgcagctatttattggttggcaagaatgttagagggaggtgaagagcctctttacattgcacgcagactcatacggtttgcaagtgaggatgttggtctggctgatccattggctcttaatcaggcagtctcatgctaccaagcatgccacttcataggaatgccagaatgcaatgtcattcttgctcagtgtgttgcttacttggccttggcacctaagtctgttgctgtttatcgagccataggagccgctcagaaggcagtgagggaatccgcgggacagaatgagggtgtgcctctccatttgaggaatgctccaaccaaattaatgaaggacattggatatgggaagggatacatctacactcccgacaatcccaccgcaacacaaacttacttgccaccatcacttctgggccacaagttcctcgattggcctgagtgacagatacggagttattatgtctttttttttttttttttttttttttgccttttggttttggggtagtaaggagaagggtgcatgctgcattgcaaacgatgtgtgcttctttgtatatttttccaccattgctaagaaatatattgacaatggtgggggtgggggaatgctaaatgctagtgcaatgcatgatgtaaattttgacccaattaaatctcattttcactaatttacttttgaattttattttattcttcaccataggccatacctatcactttatgaaatatttaatttaataattgttcgatgagttcattaaaagtggatgtatgtggcaaattaaaggatcttacattcagcaattgcgcacagatttttcagtaaaaaatatgatatcaccttcaacagaattaccaatttactagtctgaggtgtgcaatactggcattaaagaagctgccttttgttttcttacataggattgaggagttacttgtagaaagaacaatggttggcagtaggtatactacagacgcatcctagacatttgtaattttctgcattttcacgctttaaacggatgactctagcaaaacacgtgatttacaatccacctagtacaacaagctaacattctgactcatcataacaagcacttgatagttgatatacaccgaaaaaagaaacaagctctcttattattaaattaaaaagctgacaaattgggggtcaactgatgaattagatccattccttggggttgatgcatgcgtccaagagtttccattcttcgcttccttcttctggtttctgcatacaaaaggtcaccaacatttcagtagcaatttcataaatggaaaatttaagtcatctaacatccaacttgtttaaaataaagaagattccaaaatcgtacatgatcgtattcccaccgagcagtcagtgggagagaaacaagtatactttctattctccctccagttttcagtccaaatgttgtacccctatcatatacctgtggccaaaaatgttatataatacaaatctgatttgaaagagcagagcaatacattttaagtctaaagttgggttaaaaggtgtaccaaattgaattcaacatatcgtccccttcgcaattgttgccatgctttctgatgatcattgaagggcaaatccttccttttctctatgataggtaaataagcaggaataacagaatttgcacattctgcaagcaaccattgtttgggcagcatgagatagagagaattatatgtctttccagtgagaaccatcagatttataaatgcaagtaattaccagtagcaaaggaaaggagcatctcctgatcatagtcattaagatcatcaaaaaatattcctccaagccctcgcctttcacctcgatgctgaatgtaagaaataagaggaagataaggaaaaacaaccaacaacagcatatgcccatgcactcaacttcaatttaaaaaatatgtataatgaatccactctaaccccttaaacataaaagatggcctccatggcccatcaaattacgtgttatattgactcaactccggtatactcaaacgggagcactgtctatgacaactgacaaacaagagactgaaaacagattaacaattttaaaccttccgacaacatcttcctagtaatcctcctatttataagatgaagaaagtatcaaatgtttcttatgtgttaaggacactaagtagttggcataaagaagataagatagggtaagctatcatatcctattttaatctattgtttggtgagtcgattagatatgataaacttattctattcctatttgttcatcatatcttattcattaattcgaaaattatcctaaggggagagtaagattctgaacaaataagattacatagataaaatttcccttttcaccttcatctcacagtgtgcaactcctttgttccaccaccatcaccaccacaacactgtccgatgtcactgtagccagcataatcgccatgatcaccaccactaccaccacgatcataattgcatagtcatcatcttgcttcccctgcatcacatatcttcttcccattcccatcatttcattattactgacagtcattgctgttacccatttaccaccatttgtttcttgcttattaattatgacagcctccaattcatcatatattaaattcatcaaaattaaatataacagaaagccaaattcatgagtaaacttctattaaaggtacatgaactggacatggaatgcttaatactcactcatcactgttaacctttagactttagttttatcaaacagatcctaagactgctaaaaattacagtattaaaagcttcattgtgggaaaaaggattaagaattataccttgatataaaagtaatcatcacaccatttcttgaatcgggggtaaaacgtaggttcgaacttgtcacaggtttgtttttgaatctacataagaagcatgatttaaagtaagagagattttaagtgccttgattgcaaaatccttaagcatttgccaaaacctttcatagaaatataaagagaaacaaattcggtgcttaacatttcaatgcctccaattttaaatgaaccaagatacataaattcaactaaagaaaacccacctaaaactacaaaaatatattaaaggtactctcaaaaaggaccaaaatcatcaaggtgtggtgacattttagaacaaaggaaattgatttttttctttcatcttttaccaagtaaaaaagccattattggttctaaaccataaaaatgtcagaagccaatacttgtgctaagcacatactgaatggaagtgcttaacatcctcctcaaaaatgtaagctggtgtcaagtcagttcccccaccaaaccaccattgtctaggtgctccaggagcatctgcagaaagcaacagcttgactatcaatagcagcatatttaaaaaaggattcaacaactttatgctcttatgttaacatctctttggtttaatatttgttttaagattttgagacgaacatatagatatagttgtgtttttgtttttttgtttttatttatatatatatagttgtgatttaatcataagcaactgataacaaatagtaatttgaaaagaaaaaaaaaacctacaaagttgaacccgaggtaaccaagcttgaaaaagacggagcagatatcagatcatattagcttctatacagtaatgaaagattaaacagtcccaagcacacaaacaaagcccaaacaacaggaagcaaaaagacaggcatgaaagaagcagtataaaaagaaattgtgaatcacatcacatgagttgaaagtaatatgacaaaaaatactgctaaaatgataaaaagaggagcttggaaatgagcaaagcaaaatgtaatttacctttaggagcatcggtttcaaaatagcgatagttgaaatgtagtgtaggggcaaacgggttctttggatgtaaaacctgaacagaaagacaatgagggaaaattaattagtccaagaaaaaaaggcaataaaaaaaaatgagttgagatggtagagagatactaacagagctgattccagcagcgaagaaaggcacaggaccaggtttttgatcggtaggagcacccttggcagcacgatatgcgtcaggtggcatgacaccgtaaacaacagagacattaaccccagccttctcccaaacggcaccgtcttgaaggaccctgctaatgccaccgccgccaccgggcctggaccaaacgtcctccttgaacttggccccaccatcagcggcctcgagggcactgcaaacggtgtcctgggcctcccttatcatcttctcgaagcgggcccgaaccgaagtggaagactgggcctcgtccactcctctgagaaacgtatccggacgctgggcctccggggtctctttctctatcgaaagggtggctcgcactaggccttttctcattggaggtggcttccaacggcgatgagtgagcgagatcgtagttggagtgatacaagtagcggaagcggagctagagcgaaaagggaacgcgtaggacggagctgagacaatgctcgcacaaggcattatgcttcggattggatttccgacactccaatttgattcgatataagctctgaaaatgaaattcccagatgataaggtcttccttcctttcaaatacttgcagttataaataaataaataaattattttaattttacttttgccacttggtatttatctggggacaaaagggagaagaaagcatggaaatccaatcaacctcttacgttggtttggatgtgcaattctaccttgtttttgtcttctcgatttatgcagaatacaggagttgactatttaatttacataaacggctttactaaaattaaatacagtacattttatttaccaccaagcgacgcggtaaactcttatcttggatttttttttatttataatcataattatctctacttcaatgggtataattcagcgagcagtaacaatatcatgagtgatattagttttgggtccaataaagtagaagatgtctgtggtcagaccaaaaaatagtaaaatccaaatatgattagatatttaaaaaatccgtgtttaaataaatataccaattaatacatggattaaaaaagttgttgggatttaactccttccttagctatgacatctacattatatgttaattatatgttagtccaatagttttttattgcattcccaattatagtaatgatatgaaggtgtttcggcttagttctaaacaagttatctatttttttctctctttttctggccttagtgggatcttcggtctcctattctggtatggaatgaagtacctgtacaaagaatttcgacaatcaactcagttagatcgaaggtttttctaatttaagtttttcattattttttaatttacaaaataaataatggtctttaatattagtaaaaaatatataaaaaatataaaaaagattaaataaaatcatatctaaaaatataaaaagattaaataaaactaaaaaataaaaatacatttatttattaaataattaaattaaaaaattatttaaattatttgaaaaaaaacaaactaagtatataaataaataaataaaattacgactttttgaaatcataaaaaaaactttagtttacgattttgaaatcttaaatcagataaaaaatatcaaatcgaagtcattattttagttttaaaaaaattatacaactttaatgtcattatttttttaaaaaaataattaaaataaaaaaataattaaaattataaaatcataaaataattaaaaaataattatacaacttcaattttaaatatatatatatatatatatataagttaattatgacttttaattaagaagtaaacctcttgcggctgctacctgtttcacataatagtagcctccaattggggtggcagaagcgatggcattttgatggagtatagagctgggagcgcaactgttattgtttagagattgcaaatggttggaagcaaaaaaatttgccccctaaatcttattttattttagttgtatctttgagaaatttctattaaaatcatgtatgcaaatccttttttccttataaaacctgaataaatatttttttaatcaatcaaacaaattttaattatttctaaaaattatcattttcagaatttattatttaacaataaaattcataattttcaacaaccatgatttttttggcataaaaaataactgtcaaatgccctccaaaagtgtagtatcattctctcattagatttaagtctcttttgttcttttgtttgtttctatagaaattgaatccacacaaatattaaaaggaataaaatataaatatcaaattaatattgtggggagaagaaaaataaagagagatgttttattttcttgtactgaaaaaaatcccctaaattggaatgaaataaaataacattatttcattgttttctaatctaaaaataataaataatttaattctaaaaataataaataatttaatttttaaaatatttttcatatattttttttatttccactattcttataactcaaaataaataaggatgttcatgattataagtcatttgctattttaacttagtcaaatatttgggttggattttttttgagtgtttaggtcaaacttaatccaactcattcatgtttaaagtagatcatgagttttagttttaaaaatgtgaactttatttgttggttcggttgattaataaaaaataataactatatatgtatatatttaaattaaaaaaatattattattagtgataacaaccctgtaaagttctttaagtatgtattgtgtaatggtaaacaaatttttaaggacaggatgaaagttcaggtcccacatgatgttgcaaatcaattgaataatgtaggtgcaaatattagaattgtcgtgtgtttggttgaattttgaagtgttgaattgtaatagaatggggacctagatttgtgtaatatgtatgattgtttctgtctatattatttatttaaaactacattgaaatttaaaataaatttaaatttttcatcattaatcaaacttaaattaacccatttgcaacttgattcaatttgaattggattaaagaaatatatacaaatccaatttagtacctaaaattaatatctaaaggttgatttggattgaatcatgaattcagtgacatccaaccccaattaataaacacccctacaaataagaggagaaaaagcttttaacttgttttttattcctaataatacatgtttttctttcaatttcacttttttttttgttctctttatttcacttttgtaatgtacttatttatcaaggtaggtaaatgtaaggactttgatttcagaaccttatatatatatatatatatatataattttaattaattttttgttaataaaagatttttaatgttaaaacagtactctaaaaaaggtcggaaaaggaaaaatgaaattgtaaaatgtcaaaagtaccccgggtctaggtttttctctctcgtccaccgccacgccactcttcactcgcagattcaaacgtttccgaggtgaggctgaggcatctctctctctctctctctctctctctctctctctgttttctaggtatgtgtggttcgtcaatttgaatttactttcaggtaactcttagagttggattttgagtttgggcgaagattcatttccgttaccattattctcccatgccatgcaaccttctctgcttttgctaacatttttgcttttgttttttgtagaatgggagctgggcgtgaagtctccatctcacttgatggggtgagggacaagaaccttatgcagctcaaaaagctcaatctcgctcttttccctgttcgctacaatgacaaatactatgtcgatgcactcgcttccggtgaatttaccaaactaggttctactctatgcttctttctcacttccttatttccacattaatttcattcaccatctttattcttcctagttgttacatatttctttctccttgcttaacgagctactctactgggtttatgcttaccttgtcagggttttgctggggagtcaaatcacttggaatccatttgaaataaataaataaataaaacaatgaacgaactaatttttgttccaatactagttacttatttgcctccaaaaagcttcccatgattggggaatgatcacatggacaaaaagttggctgccaaaaaatatatttgatagatatttccttttatttgatgatgaagcagaagcatatatgtctatatcttggcctctgtattcccttaaggttttcttaagcttactgtacttcagttcctgcacaggttgcctttagcagtttagcttccttcacatattaaagctcaagattctaattccactgtaggatattaggtcttataatccattattaatatattatttttatctgaagatgttttgaatttgggtgttgcaattagtcattgcttacattactaatctttggacaaatgatttttttcaatcttacaaaataatatatctattggctacaaactaatccacgcattcactccagtcattcatagcaaaaccttttaaactttggttcattctttttttttttatttgtttaattcaagttgcacttggtttatttttttaattgatccgaatttcttgttcaattcagaattcttatttcctaccttttgcaatattcttcatgcattttgttttatcaaacataccctttgataaaacaaaatgcatataaaggatatgaaagcctttctaactttttggattcaaacatacccactccctttccttaacaatggggaaataaaactcctttgcagagttttgacaaacatgtgaacatatagcatagttctattggtttttctttttggtagatgtactcagtgttgttgttgagggtgagccatgacacaactgtaaagtcgtgccttagtgaccagttgatcatgggaaacaacctctttgcatatgtaaggataaggttgcatacaatgaccctcccccatactttcgcgttgcgaggagcctttggcaccagggtacattagttttttttttatactctgttgtcaaaattgcgagtaagatcaaaggatcgccttctgattcccttgcatgctctcactctataaagcctaatcacattctctaatctatctctggtctctctgctttctgtgttctgcctcccattaacaataatctgcattctacttccagcaccaacatctctgtttatgcctttgaagattttgccttcaaggggttcaagctttgtgcctcactgccttcaagcttctatttttctgcccgtgctttatgtttaagattgctattgagtattacttatgttatgtgactttttatgatttgtacgtaaccttatgattgtgaattttcaattttagtttatctaaatattgtgatttaggtgttatttttgctatctatgttattttttgtgtacgcatgtgtaagtataattttgcatttttagtaggatcttatgattcatgttacaatcctgggttatataatcttctactcccttcccggtcttagctaagatcttgattttgacaacattggatatgctgatggtttggagagctcatgaagtgatttccccccttctttttctgctttatttaaggagaatatgcactccctgtttgattttgataaatttatccatgcctagaaaaatgtacagagttatctttattggaatacaacacaagatgtcttcaatacttaatcatgtgcttttgaaagcatttggacttagagttagcatgcaagcatataatatttctttagtcgaaccagcttgtttgatatctctgtgctttcagtttgcttgatatatggatgatacagaaagaagggatgggtagacaaggagcctatagaatgtgtctaacaccattgagtactttgcctttgtctttcagcttactatagtgatatttgtgttggagcaattgcatgccggctagagaagaaggaaggtggggggcaagttcgggtttacatcatgacgttaggtgttttagcaccttaccgtggacttggtattggtaagaaagaaactgaatatctttccctggtgattgaaagtttaattgatcatttttttaatgaccttggtgtggatacctgtctcagtaccacaaatacatattaatggtttgtcataaggtgcatgcttcatattgggaacatgttaatttacatctggcaacaatcactgtttcaaaatttatcacttccttttaagctcgttatttttataaactatgcaagtgttgtgatgtgaatcttttggttcatgcaggaacaaagctattgaatcatgttcttgatctttgctccaagcaaaacatttctgaggtttacttgcatgtgcagacaaacaatgaagatgccataaacttctataagaaatttgggtttgaaattacagaaacaatccagaactattatacaaacattacaccgccagactgctatgttctcacgaggtatacggcaagcacaacgaagaaataacatttcagccagttattttgaggggaagtgatcagagattgttgcattgttttatgggttttgccatggatgtattacactaaagtttttttatgttcaatgctagattttaccataaagttagctaaaaaaaaagcagcacttggagatctcttgctaaggtactattatgctattttacccgcttgctctcatctccccccagtcttatcatttccatcaaaatactattaaactacgaattcggtacaagaatctctataaacgattatttaaaatggaggcgcacagagtaaattaaaaaaatcacataaacatattgtaaacccaatttactttaagctgcatcctgtattttaaaactacatctagcttgtgcgtcctgaataacacttgcatgatttgggcccagcaaatggctcgttatcaaaaataataattataattataatataagatatgagagggtctcatggccacgcgagccttcaattgggccccatggtcgtcactggccatcgcacgtcgactgtcgtgtctccgtgtctcttcgcatggttattggattttgtaattattttattttttatcatttgttttaaaattatattattatgtatttgttgtgttattgttttggactgtgttatgtttttgttgatctgtttttcttctttttctagatgtgtttcttcgtagaatcagttaatgagagaaacaataaaaaatgttttttttttttaaatatgcagattttcaggatttttttacaatcaacaaatctttaatatgaaaatcttgagggtatttctattggatcttagaagaatagatcttcaacttaaaatttctctccaagatctggatatggcttgagagggtcctttctacgctttgcaactgcaatcatcattaatcatcattgtatcttctgctgaggcatttgctctctttgctcaggattatcacctttcaccgtgggtttttggttgtgggaaaaggtattttttttttaagtgtatggttaaaaattataatggatgacccaatttgggttggataaaagacaaaggctacacaacataagctaaacttcttacacatagtggaaaaggatttcttagccgttagatatagtgggattaaaatcaatggttaaattttcttctttctttttttgtttgtctttccttctttacccccgattccatccctcttcttctgctatcgcttttcgctggtaacgagaggttgttctctacgccacacctcatggcgttgccactacgagcaataacgcacttcgcccccatgatctcctacttcctttcctgttcgctttgaacatcagttgtgcgaaggatcagatctaatatgaagaatcagtaccaagcattggcatcatcatatttgaagaatcacatcctaggagacctgtgaaggactttgtggtcgccgccgcactctaatcgcgaagggaaccttgccgccggcctgcagcgtttactcgttgatagcagaagccgagaagacgccattgataacctcaccattcattctccgatgaggcaccaccgcctctgtggtccttgacggtagaagagcgaagggaagagaagacgaggaaagagaaaaagaaaaggataaactaggaagcaatcaagggaaatagaagaaaaagaaatctttgtttaaccatccattaaaaataaaagaatctaacgatcaaaaagaatttgcgaacggtatgcaagtattttaactaacgcagcgtaaccttcgtctaaatatgaaactttgtgagcaacttatcttcgaagttagaaatactagcaaaccaaacacgacataatgtttagctttctacttaactgaaccttttgtcttctttttgtaaaccaagcatacttatctcatttttttagtatttattggtttacttctatttgtttcgtgtccctctatttgacgttaaaataataaaattattaagaaattatatttatcaggggtgtctgcgatacatctatgtttgatttttaaatgaaaaattatccaaactaaacataaaattcttgggattcaatctgatttcatgtgaatgtaactaataacaaatttgaatcaaatcaatccaatattttttttatttttaaaatttattttcacaagacttccaaaattattttaatttgataattgacaaaataaattattccaatgtagagtgtaataattgagtcatgatcaacccttaaaaatgacatttacataattatagtaaatgaagcaaaaaaaaaatcacaggttattataattacattacaaacctattcttcaaaaaaatgcattaaaaaccattcatagttaattattcatggagtgtctcttttttttaccattgtttttagtcacaaaaatacataactaaaaaaatactcaacacatgaagttacatattttatcatcaaaattgggccatgacttaggttagaataatgaaaatttatttggaggcataaaaaaataattaaagtataatgcgtgatttacaataggtataaaaaataaaacctaattgcaacaaaaatgtggtttctttgtttgattatttttagtttttttagatcgatttactagtttaaagtgattagattgaattttaaacatctctaacacaacaaacataggcaccaattcataatttcatataaataagagtgaagataatagaaatgtaagataaaatgaatgatgagatgcaaagagaaagaaaaagaaaaaaaagtgtcgtataacttattatataatttattattattatatgaacacaatatcttaaaataattttcaatggcagagaagaaacattaataattattttgacatttgaacgttacacacggatcctaggtgttttatttattttctaaattgtgggctatggtgaaatgatttgatggaagaaagatttatgttaaaaaaagaacacgtggtatagagttgagagtaaagaaaagtagagaagggaagatattatccacaggaggcggggtgagattagatgatgattcatgatattacgtgtataaagctggttggagaagtagatcataatctcatcctcaccattcaatatccaccaggagttggatactggtcgtactattagtgggagcaatacatatcattcattcctagctaatcctctgcttgtaaattaagagcatggctgcacaagctcttgtatcatcatcatctcttaccttctctgcggaggctgcaagacaaactcttggaccaagatcactccaatctccatttgccttctccagaaaagcctcctttcttgttaaggctgctgctactccccctgtcaaggtctgtaattcctctctcactccatttgtttttatgttttcatctatctacacttgtacttaatatataaaaaaactctctttcttttggtgttcagcaaggatcagaccgacctttgtggtttgcatcaaagcaaagtctttcttacttggatggcaggtaaatttcatcctagttcatcactaacataatataacgatatcatcatgtctggatatataaacttctcataagcacttaaagaataaaaaggtgaagtgaagtttatttcatgagttaaaacataattaagttaatttatagtagctctttcgcttaatttctccaaaaaacttatgaaagaaacttaattcattttattccgttcctggaaagcttattcgaataacacttgtgtgtatctattgcaatttagaagagtagtaaataatgaattactatgttggtgctgaaattgactttatctggcatcatgtgcattgcagccttccaggtgactatggatttgaccctctgggactttcggaccctgaaggaacaggagggttcattgagccaaaatggctagcatatggtgagatcatcaatggtcgttttgcaatgttgggtgcagttggttccatagcacctgaaattctaggcaaggctggtctgatccctcaggagacagcactcccatggttcagaaccggtgtggtcccacctgcaggaacctacaactactgggcagactcctacacactgttcgtgtttgagatggcactgatgggatttgcagagcacagaagattccaagactgggccaaaccaggctctatgggcaaacaatacttcctaggactagagaagggtcttggaggttctggtgagccagcttacccaggaggacctttcttcaaccctcttggctttggtaaggatgaaaagtccttgaaggatttgaagctcaaggaagtgaagaatggaaggttggctatgttggcaatcttgggttactttgttcaagctcttgtcacaggtgttggcccataccaaaacctcctagatcatttggctgatcccgtgcacaacaacgtcttgaccagtctcaagttccactaaatctattatatcttgttcgcttcgcagttaccaaaactcaaccatcatgtggacattttttgttccttggtgtgccgctgtaagaattgacatgtaaaacaactagaaacattccacatctttcttttatccttttgctcgttagattaaccgtacccaagcttttatttatttcagccttctgcattccaaattgcactagtctgaataatgttacaattttataaactgtatatgttgtgagagaatttttaaaaaaatcatctttaaataattaatctagttaagattggatctcgccagaatgtagttaaactggaatgaatcctatactcaaatgtgcagcttttaaggcaatagcttaactcccaacatttgtttgacggcaacctgaaatttaaacagcaatcaagtcacaagatttttttaattttgctccacaattatgcatttgaaaatcgttttaattctttactattttgagtctgaataaaaagaattttttttagtagacaaaactcatttaccacgactccgcgagggagaaaaaaagactaaacgctcttgtagagttttattttattttattccatgcataaaatttaaacatgtaactttaagagaaattaagttttcttgtcactcgaaccaaatcacgatataaaaatgtattattttcttctataacttcgaaaaaattcttaatctcattgtgatgtgtattttgcgtggtcagaatttttcgggcgagattatatgcataaaaagacaaaaactgctggaagaacaaggaccaaccaattggtgtgatttcaaaaagaattaaatgaaagttgatatttggtataattttattaaggtttaatgtaatttttttttactatatcaatcagttaaaaattatcttaagggggcatttattttacgtcatgttattcctctattctcagggataccaatgtttgttagaaggttatgagaatttataaccatgtatattgtattcccaggggaatgttatatcttcgtgtttcaagcaaattctattcccaagagaggagggaagggtatatgatattctcatgggaatataactatctattctcattacatcctgatattctctttttacttttacttttttacatttttaattgttctacaattactaaatgccaactaaatatgtatatggaaataacattcttaggcataatattccccggaatgtgattgccgggaaacaaaattatggtggaatatgattatgtgaggtgtaggaagcaaaagcccagagtttcctaagaacaaaaaaatgtaaagcaggccgggcgattcactagagggtccaacagataactaaaaacagagtattgaggcgaaggtgggcttgagtgggccataccgtacagcaaacaagtatcattttcattttggcgaacgagtgcgaatctttttctcttgcgttgttattttatttccttactatctccatctgcatctacatctgcatctgctacgttgtgttgagctttgagatctgtctcgccaaaattcatggttcctttcctctctaaccagttctcttccttttccctttgcaatatgttgctcatgatgcctgcttttgcttcttgttgctgctttttctcctgcatcgattaattttacattcctcgtgtttttgcttctcgttttgttacttgttagctttatcaatggacttgtttgctgctatactttactcttgtgatctgattctcggttttaaagcggacctgcatcgcctttttttttttttctgcttcaaaactattggatctgatttcaatatgttgatatgattgttattgtttattattttgtgcttgcatttggctgtttttttttttctttgaaaatatctggcctctcatgttgaaatgtttattccattgtagatttcgtgttgaatgcatcgtcagagttaggttaattttttgacatttggtgtaaaatggaggtgccaagtaggagaaaaccagtgatctactgggtttgccttttcgtcattgtcaatgcgtttgtacaaattagcaatgcattttatcttccgggaagctacatgcatacttactcaaatggagatcagatatatgccaaggttaattcattgacttctattgagaccgagcttccctacagctactacagtctcccttactgcaagccccttggtaaagtaaagaaaagtgctgagaatcttggagagctcctcaggggagatcagattgataactctccctaccttttccgcatgaatgttaatcagtcaatctacctctgtactacgaccgccttgaatgagaatgaggtaaagctactgaaacaaagaactcgtgatctgtatcaagtaaatatgatccttgacaatttgcctgttatgaggtttgccaatcaaaatgggattaagatccagtggacggggttccctgttggatacacaccacctgatggtagtgcagattacatcattaaccatctcaaattcacagtcttggttcatgaatatgaaggaaatggtgttgaaatcattgggactggggaggaaggtatgggtgttatctctgaagctgacaagaagaaggtatctggatatgaaattgttggctttcaggttaccccttgcagtgttaagcgcgatcctgaagtcatgacaaaactccacatgtatgacaatatctcttcgacaaactgcccatctgagctagacaagtaccaaccgattaaagagcaagagaggatatcatttacatatgaagttgagttcgtgaaaagtgatataagatggccatcgcgttgggatgcttacttaaagatggagggctcccgggtgcattggttctccatcctaaattcattgatggtgatctttttcctagccggtattgtctttgttattttcttgagaactgtgagaagggacttgacaaggtatgaggagttggacaaagaggcacaagcgcagatgaatgaggagctttctggatggaagcttgttgtgggtgatgtatttagagagcctgatggttcgaagcttctctgtgtgatggttggggatggggttcagattcttggaatggctgctgtgactattgtttttgcagccctgggtttcatgtcaccagcttccaggggtatgctgcttactgggatgataattttatatcttttcctgggaattgctgctggatatgtcagtgtacgtctatggaggaccattaagggaacctcggaagggtggagatccatttcctggttatctgcatgcttttttcctggaattgcttttattattctaacaggactgaattttcttctctggggcagcaaaagtactggtgctattcccatttccctgtattttgagttgctcttcctctggttctgcatatcagttccacttaccctcattggaggatttatggggacaaaagctcagcaaattgaatatcctgtgcgaactaaccagattccaagggagattcctgcacgtaaatatccatcatggcttcttattcttggtgcaggaactcttccatttggaacccttttcattgagcttttctttatcctttccagtatctggcttgggaggttctattatgtatttggtttcctgttggttgttcttctattgctggttattgtttgtgctgaagtgtcagtggtcctcacatatatgcatctttgtgtggaagattggcggtggtggtggaagtcattctttgcttcaggctctgttgctctttatgtcttcttgtactccattaactacttggtgttcgacctgcagagtttgagtggacctgtctcagctatactttatctcggctattccctgctcatggcaattgcaatcatgttgtcaactggcaccattggcttcctgatgtcattttactttgtgcactacttgttctcatcagtaaagatagattgaagtttgctttgctatctctcaccaactaagcaaaaggcatgctggaagaggaaattttcttaaatagtataacttttgcttaattctttttgtagcttgattgctttgcagcatgttgagtggggaaatagatgccttgctgattgcagtaattagttgccactcaattttatgttgctatgcgaactacagtttgttccactctctatctgtctctcccgtaagttgtttactcattcaactagtgtttggtatcattctgtttcatgtgatttagttttgtcaagttgtttgaggaagttgtaatttgcacagactgtctcattccttattcaaatatcaagaaaaattaaatggatacttctaggtttcttcaaggtatccatccactgtgcttttgggtgttcgaatgttttgtgttcaaggataggaaagtgacttattcgttaacatgatttttcttagttatccacatacggcttggtaatatattattattattattagcaaaaatacaggcgtgtgtctatatttctattatgttatcatatttttttatttaaatttatttggtcatacaatataataaaatataacttagattatttctatagaggcaactctattatgagaaggtgtaaaaaaagatacaattattattgttctggtatatcaacaaaagctatttgataatacacaattaagagttgaaaggaaaactagaatgcattatttcttctccgattgattaaccttgaaaaggaggagaaagaaaaaggtgaattgtcatccttatacttttgtgtctgtatttttattttattattacattttttgctaataaagaaaatgataaacttttaaatttaatttaaaaaatctcagttgtattaaaaaagtccttgtcatcatttgaaaattattttaaacataaatcaattgagtcaataaattaatcagtgaagcctcctccgaaatagcatccaaaataaaactaaaatgagcacggcaatagaaagtaaaaacatgaaaaagcacacaaaaaaaaagacaaatgcaaataaaccaaagtgatttatgcgtacatgacctatttttaaaagcactgtttattttagtgaatggaaatgaaaaatgaaaggtttgattcctgaaaaagagatgcagaggaggaaagggataattgtaaatgggagagagataattgtgaatgtgaaagagtcaatttgaagttatgttatgcacgttcatgaagtagaaattatttttgaataaataaatcggcgataactgccgtgagtgagtgtcaatagaaatgaggagaaaaaaatttctaaaacaagaggataagaaaggtaaggaaagtttgaaggggagatttacgggaatgagaaaaaggataaaataatgcagtggacgtgtgaacatagtagttgaagggagaattagagtttgcaattatattttgaaaaatgtaaaatatcaaattgtgtgggagaagttgcagtaagccagtaaccaacaccttttctgtgagacgcaacaattatttttgaagggtaaatttggaaacgaaatgtgtacaaaaaggggtaaaaggtcctgggagtgttgttatgaagtacgaaaaatgtagttatatattgaaagataaattagaaattaaaaatatgtataccaaatggaattattttcaatatacagattattattatttcatactacttcatactgagaacatacatatttgtcgtggatgtggaaaaaattaaataaatgtactgaaaacgacctgcaaaaatagaccagtctattagtcgctggttcatggaattggatcctgtgatgttccttttcgtattctggtaaagccaaaacaagtttaagggatcgtgtacaaataaggtgagtcttgttgtgatgtttgtgtctttatcttaagtctgagagagatatgcgcatgtttcttttcacgtctgattaacaatggacgtggaagctacaagttgtggcatcaagatgaacccgcatgatgtccctacgatgtgaaaccaaacacatgctaaatttgttttcagtaaatagttagtgtggagaggacaactggttcatttgtctgtctatctaactctcttgatactgtcaatctcatcacaaaaggaagctatcctctcctgctgctgatactagctagtatcacctttgttaggagttgagtttgttggttggttttcatgtatcctaaaaaaaagaaaaacgaagaaaaaaacatttataaattacaggtgttttgtataccttcctcgtaggttttgtatggttctgataacaaactcccggccacgctagaagtgaaagaattataacaaacctttgttataaggattgcttcttctggctagtattcccttagccatgctcttcagtttattgtttatccagtttggcaagttacaagagaaacttttgcgtggatcttgtctgcacaagctatttagactaaattgattggtactatatgcaaaattattttatatttgacacattacagaaatttgttttttgacaagataaggcatacacaataaattcactctagtttttctcaactagttattcaaataaaatcctaaaacaaacatcacgagaaaaaaaaaaaaaaaaaaaaagttgccagcaagttattgtctaacagtagaacattacaacattatattgggatgggaaccccgttccaatctccaagacattccagaatgggatcaataatctttgcttgacacatggctgtatatactttttcaaattcctcatctggtgagagagtcttttctccggtgagcaaccctatctctaactcttccctcacaaacttgtacagtggatatgacctacactcctttattctgtttggaattgctggattgccattctcataagccacccttgcactttcaacttcctttggcaagagagacttcaattcatcctcaaaagctccaatcttctcaaaaatcaacaagctcacattcttgtcattaatggcactaatgtgtgcttgctcataaagtacttgctttagttttggcatcaatgggtacgtaacattggagggatcatcaatgtaggaaaatacatattctctatcgaccactttaagcaaatctttctcacaaagtcgaaatgggttaatttcttctgtgtcttctgtaactaatgttttctgtgcaactatgcttacagtattcttgaccgtgttcttgaaaatttcctctaaatgcctcaagtcaatagcttggcagagtgcaaccagataagtggaagacatgagctttaatatctcaacggcttcgacagttttcaaagcagaaattaagcccaaagagttcacatcttggtcgtgctgctcagcactttgcccatggctcgttactggatttgctagatattgaagctcagaacaataagcagccatggcaacttcagatgccttgaaaccgtaatcaagacttgggtttctaccagcagaaagacttgatggcaacccattgttatacaaatcattgacaagctcagtaaattgggcgaagatgagtttgccgattgaagcaacggctaaacgtgtattatccattgaaactccaattggggttccttggaaattaccaccattcagagccttattccttgtgacatcaatcaagggattgtcatttactgagtttatttccctttcaattgatttggtcgaataccggatgatttcaatctgtggaccaagccactgaggagaagttacaagagcataacgatcttttctaggcttctgcaacggatctggttgttgcagtgtaacatttttgacataagagcttccatctagaatgtgttccataatagctgcagcttcaatttggccgggatggtacttcagcttatgtataagatgatgtgtaaattctggcttcccctatgcatgacttcagcaaaaactgctgacagaacttccgacagtaaagctaatatgtttgcctcaaaaagcacggtagaagccacgccagacccaacggccgtgccatttacgagggcaagaccttccttgggcttcaactcaaagaacccagaatctagacctgctaaatggaaagcttccttagcattaagggactctccagagggtccaacagctttactgtttcgcctaccagttagcaatgcaacaatgtaggacagaggaattagatcaccagacgcagtaattgtaccacgtaatggcaagataggggtgacattgtggttgagtagtttggtgatagcttctaagatttcaaatctaattcctgagtagccttgaagaagggtattaaccctcacaagcattgctgctctggttgctgatttaggcagtgtgtgagataactctgtttggtagccaaatattgcgcagtttaaaaaccttgggaaggaaaaatggaaaatccgtaaatacataaaccaaaagaagaattaaattggaatggaatggtctatatactgtcatataatatataggttgttgtcacatatataaaagtaagttgacttttataattgatactttgaaagatatatttgaaatgaattttgattagtattgacaatgaagttgcatgataattccaagatattgagaaggaagcagagaagaagcagacctaaccatttccttctgaagggcaaggccttggtcagttcttctgtgggaggcagcaccaaagccggtggtaacaccataaatgggagtgcctttgttaatgttttggatgatccagtggcagctggcgtcaacgcctggccttgaagactctgagagggaaaccttagcctgcaagtaatggttgggatcggcaacagcaacagaagccacctgtgatatagttagtgtctctcccccacccagacagacaagtgggttccggtactctgccaccatgcgtttcacttcatcaaagtggctacacttgagtgaatctgctgcctgactccagttaagggggtcactttctggaataatgctcgccataccactacgagaggagagttcaaaagttgtagagttttcagaggccttgaagctttaagtagagctagagggttgctgacatgtgtcggggtaggtgattaggtgcttctatctaccattcacccactcattttttgcatcttacaattgtagcttctcaaatactgtctaagtacaaacaaccagattaaattataaatttggtcactgtctgatattaattttagtttcaatcataactggcaaataaatttatattttactactctctgcataaaaacatatttcaatttttttcatacacggcatctaatatatataaaaggttttttcttttttttttaggaatgaagtagtaaatttacctggtgcatgggttgcactggtatttatgtatgtaccaaaatagtttgttggtttgtaaatataatgttttaattacaatttgatttgataaattatttaaattggttgttaataaaattttataaacataaaaatatatatttaaacgttttagctagaactcatatttttgaatgatttaagacacattattcttaaatcatttaaagataagaataacttcttcttttattttatcaatatgatgtgttgaatataaccgtataaattaagagatatatagagcgcaagttatcgtctcttagtagtattgtagtaatactactatataaaaaaaactttaatatttttataatctttgaccgacttaattatttgtataacacgcatatttcattattttaataagaagacataaaccttttccccccacgtgttgtgataaattcctgaaagtatacattttttatttgtgtagctaaaacaatgtattattgatagaaaataaaaagaaaagaaaagaaaaagacatggaatagtattagtaatgacaggtttcatgttcccgtaaaaaaaaaaaatgatgtttactttgttattacattacacgcagttaacagtaatgaaaacttaaaattagtaaacataaatgtatagaaatccgtgaaaggtaaggaattataaatgggatgtggaaattataattactctgaaaatcacatcccagatgtatatggtattatatttgtgtgtgatataataaaaagaggaagaaagaattatttgtgacgcatgcaagaaggtttgaaaaaagaaaactagccgttggcaagggtacttcatcatgtattagttgtacattgtgattcagtgctttaggctcctctctttcctttgcttttgcttttgcttaattcattgatctaaattctccttcctctctctgactctggcgaagatgttcaccgaaggactcgacgagagcgcaatccaatggatcaagcaggtctcctttcttctttcttctttcttctttttgtctaatctaatgctacctctttgtttctttttccatctttctttcttttgtttgattctttattagggattccattccttcactgaccaatttatacatacaatacaatacaatacaatacagggatcaaaagtaccacttgatgttgatgtcgaagagcctcctcttcctcagccacgctctcctctggccgagaaaatcagctgcagcagcgatcgattcccacgatctcctctcttgagcagtgccaactctcttaattctcccgttctccctcccttgaagttccactcggctttattacaaccgcgcaacctcgcctttgccgatcacgatgacagttacgaaagcacggaggatgccaatttctccgatgacgaagtctctgctcccaacaaccttgatttctcggactctccaataccacactactatgacgaggaacaattgtttggatgcaaaggccgcagaggaattctcaagacaggtttggccaatcaaaacctaaccattcaggttcccaacacagttagaaggttcacagatggagaaatgggtttcaatataagtcttcaaaggaacctcactccagctggcgctgccactgttcagcttcaaaagcaagttcaccttcgcaatgtgaattgccctgatgatgacaccgttggtttgggtactccaagtgcccctcccatcattgattctgattctccactggagagggattcagaatgctccctaaggaacgaaccaacttaccctcctggatcatggccttcaagagaatctctggattatgatggcacaaaaagtgagacttccattgaacaaaaacccaagcccaacactgttgctaaacccactgtcgctgagctcgctcaaaggtgctgtatttgctcttttttagtttgtctgtttgcagttctccttccaattcctaaccagctctagtgtccttccttataatattaaattcaactctgcagactggacaagacttttacagatgacagagaaagacagacccctcatttacaatattacaacaccaggtgctgtctatcttcaacttttactttctatttaacaattatcaaattagctgtcaaccttaacgaaatatttagtttagtttgaatccattaatactttgctaaaaaactaagtaccctgttacctggaggctccacgctatgcgcaggtaagggggatggatattgtacacaactttactcttgcatatgcaaagaagttgtttccggattcgaacccatgaccaacattaatactttgctaattatagcaaaatttaattaatatagttatcttgaaattcacatttatatgctcacttccttttatggcatgttatgttatttcagcagttgcaatagtcaatatgcctggcaaacccttatcacttatgatgcctgcatacgtttatgcctacaagcatgggcaaaaggctgcactgaggccccagagtttttaaaagatgagtgcctagctctccgaagtgctttagggtgggttccattttgttttaccaacacatttcttttggcttcatttattgttctcctcatttctgttatttctctatttccatagattgcatgagttcttgttgcaacctcgaggtgtcaagccaactgaaggcagaaataccaggaattcggaacaaacagttcccctgaagattaagaaagttgtagggaaaataagagtggaaggtaatcttacaatctcaacacatttttatcatttaaatgtaatatgattataattgtacatggatgtatggaatgacattttcttatggacatattttagaacttcctaatgtaactatgttcataacgttggatctccttcaaacaacttgagagctgtataatctgacatcctatatgaaaattgcagtgaagaaacttcgcattataccaagacaaaaacttaagatcacaaagtcacagcgaggatcaatctacatgcaaactggggtggagtacgtccggcatgtttcatcacttgtgaaaaatggcataaattctatgaagacggcctccttctccttggcatctgaaggtttcagcaactctttcgttttatagtttagaaatctttttgatcttgataatgagacttgtattagactgtaagagttacatattatcaggatttaggagtcatactttatcctccaccaaatgaaatgggcttttttaatatagatttttttcctttcataaacaccaatccttttaatgaatgaattaaaggtatctgttttattcttgtagagccactacattgttcgatccaacttaagagtacaacggaagaaaatgaatcagagccatgttctgcaattcttttgcgccctggaagtggagattaccatgatttgtaagtttcattttttttttacttttatattttaattgggaaaagtgtttttaattgacctgctgtttggctcttcttagaaaatagctaaacatgatagtcggtgaaggttttccaaatgcattttagcaggatatttatagtagtagacaattgatgaaaaaccaatcttaacagttgatatcatacactgctttatgttctaagtttcttccagtacacagcctagtgcataagatggcgatttacattgtacattctttaagacaactacaatcacatgttgtcttgatttcttcaattgttgaaattcgcataataatcataaagattctgaactctcacctactttcagtttcccattgagccaaggggacgctttaattgtagaagtccaagattcaaaaaaggtagtccatggtgaagccaggattccaatttcatccctcagtgataatcctgtatgagctctaccctttcatcgtccatggatattattctctctcttgcaccttccacattcacataatgaattatcttgaatgtgcagagtgacagaattcggtggtggccagtatatcatgatgaacgtgaatgtgttggcaagatccagctctctattggcagtacaatgacaagcgatgagaacaatcacataaaggttctgtctctagcaaaatttagttcaataaatcttgttttatctaatagaaatattcaagttagttgatgtaagatcatcttccaagttgacatctcaggactaaggcaaagaagtaactgtttaggatacatcttagatgtaatatatcgaaaaattgttctcaagaactagattctttctgagattaaccatggagaggatcatacttatcaccttgtttaatcatttgttggtattaaaaagaaaactattctaatttgatcggacaaaggatcttttatttatttattgaaaaggctcatcatgatttaatattgtttttatcttagtttaaacttttggccattaaacaccaatatcaacatttctggctatgctgttctgagcatagattcaggttttcatttgctcggtttgtacatttctgcagagtgcggctgttgtggaaactcaagcttatgatttattattggagggtgccatgcgtgcacaacatttccactcccgaaacttgcggttaaatgggccttggaaatggttgttagatgcatttgcggactactatggagtttctaattcatatgccaagctgaggtatttgaatgtgtgcccccaaaaatatgaaaataagaaacagttttctgatattctttatgctacatgattttcttttaatttcttcatttttcttcacttacctgtggtggttttcttgtagatatctattacatgtgatgaatgtggcaactccaaccaaggactgcctagagcttgtgagagagttgctagaacccctcataaaggccagaagtgagaggagtctgaccaggcaggaggtaagtcatatattgctctctttcccgttgcagtaatttaccatatcttgtaatttggtttgcttaatcttatgttgtttcagcttctcataattttaatatgctatgtcaatggcattagtttagagttcagaccaccttaatacttgtcatacatatctagaaatggatggtggtgtaacagttttctctgtttgcttgttctcacagagaagtatactttcagactgtgaaactcaaattgaaagtcttctagcgacagtttttgagaattacaaatcgctagatgaaaactcgccaacaggtttaacagatcattttggtccagcatttgatgctgctgcaccagctttagatcctgctgttcaagtctacacaagtgttcatgatattctatctctagatgctcaaactattctaagaaactatcttcaggtaattccaaatttgcagagttactgataactaatgctcttgttcaacatagtttcaaccatggatgtttgaagtatatttatggctgcatgtaaagcttggttttccttttttggagtctaaatgataaggctactgtcaacagactgcagcaagaaaaaggtgtagaaaacacatgatggagactgatgaatttgtgtcgagcacctctgaatgttacctaatggataccattaccatctcaacggcatacctgaagatgaagaatctttgtgtttcaataagaaatgaaattcaagcagacataaagatccataaccagcatacgatccatggtcagcatatatttccaaggtagttggctataacagctctctttagcaagttgacaatacagttaacagtgcatacaatttgcaattcaattctcacacataattataatgaggggttgatatttatcttttttacatcccctacatgggagatgcaattggtctttattaaatttaaacattctgcaactttcaattggcataacagaatgttattttctcctgtttcagtcagagtttctcattatcaacgtcggtacccattcatccaatgatagcattactcaaattctcgttatttttctctgtaaattttaattttggttcatcatagattttctgagttctattttccaattttcagttcaattgacctgacaaacatcacagcagcagtttacagcacagagctgtgcaagagactgagagctttcctttctgcattgccaccatcgagtccacaggcacatgtaaatgagcttctagttgcagctgcagattttgaacgggatttggaatcatggaatataaggtttgtgaaagaaacttctcccatgctaatgcaaaatgcagtataaaaaagacatgagattccccaacagtaaaatatcatttcttactcgcaatactcttcatgttccagtcttgtgcagggaggcgtagactccagaaatttgttccacaattatatcatggtgtggatacaggatatgcaacttagtttgcttgatttatgtaaagcagaaaaggtagtagttattttttttttttatatatacaacaaagcacttcagtctataaatgacttgacctccccaataatgacacaggtgccatgggctggagtaatcacaaaccactccacctccccatttgctgaggaaatgtacgagaaaatcaaagacaaccttacccagtatgaagttgtaatcaacagatggcctcaatactcactttatttggaaaatgtaagttctaaattagagatatttctgttaaaccatcagcattccagatatctttttctatagtgtctccctcctctcatatatataaacaattctatctccactgtataaaacatgtggtaaataccttgactttgcatttttcttaccctttctttctgtaaggctgttgcaaacattgaaagggcaattgtgaaatccctcgaaaaacaatacagcgatatattaactcctttgaaagatagcatacaaaagagacttcacttgcaagttcaaaagatagcaagaagacaatcagctactgttcatttggttcctaatcaagtaagttctctgtatgcttttgcattaggtccatattctaaaatccagcttaatttaagtactcaaattttaagctcactcaaacttttgtggcataatagaaaacatgcaggattttggtttcttataacattttgttttatccacagttgggaatattcttgaacaccctcaagaggattcttgatgtccttcattgtagagtggaagacatcctaaattcatgggcatcctgtctacctgtcatgggagataagaagacactgtttggggagcaaatgaatggaatcactgttctcttgagaaccaaatacaaaacttatttgcaagcaataatagggaatcttgtcaacaatgtaagatcattcaaactccagttttctacgtttgttctatgttatcgtaaaatggataacaatagtgagcataaagtttttgtttagaagcctcaaatatttatttacatttgatacaattgaattgttcagacaaaagctaatcggaacacaaggctgaaaaagatccttgaggaaacaacagaaacagatggagaagcagaagtgcgtgaaagaatgcagttgctgaattcacaactcactgacttcatctccaatctgcatgaggtctttaccagccagatttttatagcaatatgtcgtggattatgggataggatgggacaggtaaccaactattttaaaaactcctatattattggttcatatttttttctttctcggatctcatttattttcattggttttgtgatagattattttgaaatttctcgaagggagaaaagaaaacaggatatggtacaacggctcttcatatgctctgggggtaagtcaatattattagattattttctgatgatgttattgttgattgcaatattgcaccgttgacgttgattgtttcactttgcagatattggatgatacatttgcttcccaaatgcaacgattacgaggaaatgcgttgcaagaaaaggatattgagcctcctcgctcagtgattgaagctcgatctattctttgtaaagacacggcaaatgcaaccgatacatctaattacttctatatataatttagctttatatatatatattgccaaatttccttgctattgttgaaatgtccatccactgtacatgatcgtcaagtcaaatataaacctggtaacgtttttctttttggggggagggggattcattttattcttttgcatctaaatgtaataatgtactattgttcagacttcagaggttgaataacgtgatagagggctattattcttcttgttaatttcctatcaatctaaacacatgatgagagtgtttgatctaaagaaagaatccagaagaaattgcatagataaagtaagaaaatattttatatttatagactttttatttgtcttatctgttaactttatttatatttttaattaattttgtcttttattaattttcttttgttttttattactatgattttatttttcacatttttgtgtgtagttaagggattttatatatatatatatatatatatatatatatatatatatatctttttgtttttgatcatgtcatatttacagtattagtcgtataaatttgtattaaaattgatttttggatttgtatttggatgtttttttctgctgaattttatatttggattatgaacatcaaattataaataaatgacttaatcggtggttgataatgttagaaaatagttttattaaatttttgtaaggtttaagatgatttttcctcttaagagaagtttataaaatgaattttttatgtaaaccttaaaacatgcgttaaaaaatgaatttaaatatcttttaagttaacatgttttataatgacttcaagataatgttatgcttagtttttttccttctaaacaagtaaataaataaataaaattcattgtcctaaattttatttatttattaaatgctagcataaaaacaaacatcattatatatttctataatttgttaattttgaatataaatgtttaaaaatgataacaaactaaaaagcaggaaacatgatttgaattttttttttgttttgtaatttcaattagaaaaatatttggataatctttactctctacacatttttttatatttactttatatatttattcatttttcttatttttctctacaccacatatctaactttgaaatatataaaaaatcttcataattaaaatatatacaccccttagaacacagataattaaagatcaaaataagaagaagaaaatcaacaagtgatataataatgttattatttcaatgtttcataaatacatataataaataaaatgatattcaaatatataccacaaataatttgatgaattatgtataaataaacatatatttaaaaatataatatattaatttatcatgttatcataacaaataaataaatttaagtaaaattatgtatacattacaaaacatattaaactaaaaataatatgacatcaatttatagataataaaagatatcatttcaatatataaattttagcataataaagtaggatagcttaatagaaatacgaacacatatacagtaattactataattattaatgagttaatgattaatttattataaaaaaaagtaatgatcacttttttaatagttcaaacgtatcttgttattttaatgaatcagtgattattatttttagaggtaacgtatatttattattatccatgggatacaaagttacaaagtatgggctggaactggatatagaaagaagagaagcgaaagggcgcgagggggaaatggcgaaatgaagggagggaaagaattagaaaatggaaaatattcaaaagggtgattccctcgctccggaaaatccgaaatttggatattccactttctcacttttccctataaaacaaaaaagcacccgaaattgttggcagtggaaaatggcgcagcttccgtgcgactccgatggcgtgtgcatgcgctgcaaacacaaacccactccctccgaaaccctctcctgtcgaacgtgtgccactccctggcacctttcgtgtctcccttcgccacctctctccctttctgattcccactgggactgccccgactgttctgacacctccaatcatcaccccgtcgctccctccggtgaccttgtctccgccattcacgccattcagtccgacccctctctcactgaccaacagaaagccaaaaaacgccaagaactcctcgctggctctgccgacccctcaaaggacaaaaccaaaaccaaagacatttttgatggaagcttaaattgctccatatgcatgcaactacccgacagacccgtcacggtttgtttcttttgtcttctctgttttttttttttttatcatctattaatttttgagtagtcagtgtgttagtttcctcaatttatctttcagacgccatgtgggcacaacttttgtttgagatgtttcgagaagtggatcggacagggaaagcgcacttgcgccaattgccgtgctcaaatcccgaccaagatggcgagccagccgagaataaactctcagttggccatggccatccgattggcgaaggcagccaagtcgggaggttcttcgggtccatccaaggtgtatcattttgtacgcaatcaggaccgccctgatactgcattcaccacagagcgagccaagaagactggaaaggcaaacgcttgcagtggtaagatttttgttactgttcctcccgaccattttgggcccatccctgctgaaaacgaccccaccaggaaccgtggtgttctggtcggggacacgtgggaggacaggatggagtgtcggcagtggggtgctcatttgcctcatgttgccggcattgctggacagagtggttatggttcccagtctgttgccctttctggtgggtacgaggatgacgaggaccatggtgagtggttcctttacactggcagtggtggcagagatctaagtggcaataaacgcaccaacaagctgcaatcctttgaccagaagtttgaaaacatgaacgaggccttgagagtaagctgcaggaagggttatcccgttcgggttgtaaggtcacctcttctctctcgatcctaatatttttcattcgattaccaactaaatgcatttttctgagtatcacaaatttattttgtgccgaaataacttttgttttgttcaggtcgcacaaggaaaaacgttcttcttatgcaccggaatctggagtgcgttatgatggagtttatagaatagagaaatgctggcgtaaaaatggaatacaagtaagctacttctaatgataggcattgtgtttattgattgaggcctgggaatgtatttttccttgatagttttctccaagttttttgattcatggagaagctttgttctgtgacagggttgcaaggtttgcaggtatttgtttgtgagatgtgacaatgagccagcaccgtggacaaggttggttggttctttctttgctgctgtttgtttgtgtgcttatgtgttattgactttattttgttgatgtgcagtgatgaaattggagatcgcccacgctcactgcctaaaattgatgagttgaagggggcagttgatgtaactgaaagaaagggtgatccatcatgggattatgatgtaagtgttgttctggtcctttagctgttgataggttgatttgtgtctggtaggattaaatagtgagacaatcataattattgtactaaagagttttggaaatcgttctagtggtacatgttccactattgatgttctataatctatactttgatgggtctcactcagtacttttggtgaaatataggaggaaaaggggtgctggttgtggaagaagcctccaccagaaagcaagaaatcagtggacattaaatctgaagatggaacaacaatcagagttaaacgaaaggcaaaagatgtgtctgtgaaagaaaggcttttgaaaggtatgctctgtgtacatgttcccataatttaccctgtatagactacttataaatcttgtttgccttattgttttttaaaatcccattgcagtcaattgaacttgtaaaatctattcaattttgccactgacttccaatttgttcagagtttggctgccaaatatgtctcaaggttatggcttctcctcttactacaccttgtgctcacaacttctgcaaagcctgtttggagggtaccttttctggccaaagtttcatcagaaatagggcatgtggaggtggacgcactttacgagcacagaagaatgttatgaaatgcccatcttgttcaaatgacattgccgactttctccagaatccacaggtactactgaatgccattattaggttttatatttgctccaagtatgcttgcaaaccatatttggatttcttttaattattcctagtttacaatgaaatgcttatgcctattttttgaaaatatggaattcaattagtaaaacggttcatcttgaataaaggagaatggtagaaatatattaaggctttattttgagctcgtgtatatgctttttataaggcttgaatatttgttgcaaatactactggcactaatgaaatacattctggaatttttcattcattgtattcaaattggcattttatttgtaagttttgttctacaattttctggccttttttgtacaggttaatagagaaatgctggccgttatagaatcattacaacgccaggctgaagaagaaaattctgaagagtcaagtgataaaaatgatgaaaatgtgcatgatccaacagaggtttcaaaaccttgtgattctagtgataaggtgttggaggaaattaaggacaatgagctgaatcagccacacaagcgaaggaaagagtgaaggatgactgcaagttattttggtcctttggattatggattttcattaaatagcaagggacggactgctgatgcaattgttttttagtgctagcatagattgatggattttgactaatatatggatttaaatatattttttgtgcgttatgatcggagtagaggttcatgtgatagaatattggtatctcctttattgtgggtttcatgtctctagaaggagagaatgaatgcagtttacactgtaatgcatatcttaatgcattctgtgtttttattaaagatgttatgtttactactacatttaaacaagtttaaatttaatattgacttctggtgtaaacttaaatgaagagccaagtgataaaaatgatgaaaatttgcattgcccaacagaggtttaaaaaatgatataatgataggattaaaaaacttcatactactacgcattgtaggtacacagaagtatacacgaggtaaattctgagaagtttccatcctttgtgggacatcaacttgtgaatgtagcttttgattcaacttaaatttgctataattggctcacaagtatgtttgtctaaatatcttgcatcaacttgtgaatgtagctcgaggaaattttgaagatttgagcaaggtgaggtttaaggaattaggtaactaaatctgaaggtaagctttgttatcctctaactcacctttttatccaatattataggattctttttttttttttttttttacaacgttttacccattaggttattagaatacataacctttttttttttttaccgatttagcatgtgtattgttatgatataatttaaattattgatggattgaaagagatagaaagttgcattgttaggaatattaagttgcatttatatatatatatatatatttttttttgaatttgatttatgataatcagttataaattgttaaaatttaaaagcttaagagcatattatgataagagaatattgaaatgaaatgaagtgaatgttagagaatgaaaatctaaagtagatgaacttatgcgttttgtaaactaaaagatcattatcttttcacttaaagagaatcaagaatctgaaccacgtaggtcaataagttacaaagagagtcgaaaaggtaaatctagaagactgaaaatgaaaattcgaggaaagtagacctttaagtttaattattattacattacattagtagttacaaagaattttctaaccaattttatatgctcatcagcgctgaaatttcaacttccaagtaaattaaaaaaatgaaataattacgtagatatgttatgggttaggatcatttgtcaaattttgcacaatgatatatttaattattcgctcgaattgccgcccttctcatgtggtctgatactcggacacgtttttgtattttatttaaagtattagttgactgacttccggtcgtctctcaaaagtcttcgttattaattataatgcaaaaatgattttttttaataaataagaaatcaagaatcagatcattttcttttcttttctttttaggatttttcttacggcacctattcagtaaccacagactaatttctctgtttgataggtaaaaattatttattaaacaaatttaagtcactttattaagtaatatgtacgagtattataaatatttttatattgtcttctgttcttataaataaaaaaattaagattatttttcgttgataatgtttaccatttttaataaataacacgtattgagaaaaatgataacttagtatttattattaatatacaagattgaactctttaagatcttttttgctctctaagttaatactgttccacttccatgtatcatttgaaaaaacaaaataacactcttgagatgtctataagtctattgaagaagacataaagaaaaagaaagaaagatgctaatagtaattgagtaataagatgtaaattgtaaagaagcttttgccataagctttttctgcgtaacttctaacacacgctgaggaggacatcccctatttatatctcatttcaccatactgtccatacgtaaatagagccccattcccctgcttacatagagagcacttttcataaaagttaaattccaagagaatgaagaagatacaagtatcaatcaagtttctgctttgtttatctctgctctgtcttttgttctcttcatttcttttactccttcaatccttgaagccatccctcatgcaattcttcagctacatggttgaaaaaagctacatgttccttctctgcaatggcctccttcttgttttaatagccatcaactctgctccaatcaatgcctcttcactaccaaccactgaacatgctgctgtagctgttcacatagaagagaaaagtagccagttagaatccaaggaaccagacatggcagttgcagcaccaattgctggtgaggaaactgaatccccacataaagaagaaaagattttggtgagagtagaacaagacaatgttctatcagatacccaagaagaagaagaagaagaagaagaagagggaaatgcccttgtgatcattgatgaagatgagcatgacactgaagagttaaataagaaatgtgaagattttattaaaaggatgaaagcaacgttctcttccaataacttggagctaagagctgtcaacagtttttattttgataatcagaaattgctggtggctgttaattaagtagttgtgaatcttagaacatcatgtatctccctttcttttgcattgattttaactaacagggtgtcttagtttccaagtttttttgccacccagatttttgcttgtaggaattaaatcctgccctaaatggttctgtcagactatgttccatgttctgttctctgttccaatggaaacatcaagctcactctattttattaaatgcacgtcttgtttactacagtaattaactttagcatctctttcaattataaacattttaggtttacacattcaacttgtatccatataatatgattcagttaaatctaattttcatttaacccagaaataagtaacgtctaacataactccattaactcgtaaagaaggatgctgctaaaatggccatttgagttcaaaaatatgatacttcaattcgacttgttttgtttagcttcttgtgagagaattccgtccatctggcagccttataataaaattcaaccaatgtcactatagtagataaactttattatatatcatcgttactgatttgagcatcaagactattttttttaacaggtatccaccctatccatgatatctcaatcgtatcacagattaaagagtgcactttagtgagcgttaccccagtcaaaatcatcagctctatcttgaatgcgctttttataaaaataaagtgttttgtattcgctctgtgaaacatttgtttttgggctttcataagctcctgagtggaaacttgagcaatgtaaaaaataattttggatttgtggaaaagttccctttctaaaggcgggtctggaaaaagaaaacacggatagtttataaacaaaatgacttaaatatatttttaatttttaataaatacttaatttttgtgtttattttctaataaatttttattttacttttagtccctaataaattaataattttgtttttagttaatgacacttatttgtaatccattataaattaataaattttgtgtttgtttaataaatcttttttatttgttattagttgggactaaaataaaatttattaatttattaaaaaataaatacaaaatttgttaatttattaagaatgaaaacataatataagaactgaaaataaaaatattattttattaacaattcacacaaaacaaaattttattaaaaaacaaacataaaaatcaaatatttattagaaataaaaacatattttaatctaaagaaaatttgtcaaatatcttttaacctttcattatctcttgcaattcaaacacacaatcaagctaatccttattactttgtttaccttttttatattatatccagaaagaaaaataatagagtgcacagcgtattattgctgacatgttattcgggttaggatcagctacagttttgttaagaaactgtatgggatctcatcccttcatttaccaaactatctttaatatttgaaaacctcgtatatgacattagtaactgcattgggttcaaattttcaagccgcagagatctaattctcagttatgcttatttaaagtggcagattttaatgtgtgatagatagaaagaagaatgcttacaatatactcattttaatatatatatatatatatatatatatatattttatgagttaaaattgattgcaacttggcttgaaaatgtattagagaggatatttacagcatttctgtgcaaggaaataatgtatttaacaggttgtgaatgaaataaaataaaggatgtttgaaattgatacggtggcagagtcaggaagggggccacgtagcttcctttgttgaattgaaacgtacgtccttctcaagttggcacaataatttgacaacggatctccaagaaatttatatgcggcctctttatataaaaagttatttttgagagtgtttctattattaaaaatataatttttttaatagaaaaattctcaaaaatatttctaatcttatattcaaagagatccataccaaacaattctttacttgacatgagtcaagtctttatttctgagaaagccaacgaaatcatcataataaacggatacagagcgctaattttccacaaactttaagaatgtggccctacataaacatttgtccttcgttgataacaacatgcatcagtatcgttcagtctaacttagcatagccatgagcactccatcactctcaacctcaacttattctatttttaatctatgcacctttccaacacacggagtaacatccaacaactatcctcatcgcaccatttttttatattaaatataattaaaaatatatcttattaataatcatgatggttcttcatgaaaaaataaattatgtctttctctctctaataaaaccatgaactaatattaataaaattctctttaagaacttacaaaaaataagtgtaaaataaatcatttttatttatttataaatgaaaaccaattaatttatgcatcttagtttttaaataagttagatgatagagtttttaaaagaaaaaattaagtaaataagttaatttaaaatctattgtatttatctttttaccttttctcttattcataaatattgttaaagaattatctaaaactattcaaccaatatatcattaattatatattattcaagatctcaaattgaaatcttgtaaataaaaaagtgattgaaaaaggaaaccttactaacatgactaattacatcttcttctaatattacttactagcaaaatcgattaatacttcttagcaataatttggtgactccaaatatgtcatataattaattatgaataaatagaagtggatctaagttcctttagttatattttagaactttgtttgtcctaatttgtccatgttttactatataatttgacagcttaaaataatttaagatctaggatcaaaacacattgccaccttatatatccgagtctctgtcagctttagtctgtttgtataaacttttttagaaatatttataagataaaagataaaaaagaataaaatgaaatttttcttaaatttgaaaaaagaaaattcgaagatgtgtgatttgatccagatcaaacgggttatcaatttgatgacaaatcgtgtgaccacgaacccggttggttcacaccttctggaactgattttcaaaacatggctaaaaaaaccgcttagacacgtacatgtacacactttttatatatgacttttaggacttcgttaaaggttttttgttaaaccttttaatgaggacttcgttaaagttacagcaaggagacatgtataaaaatgaacacaattgaattcaggtcggaaaaacaagacaatgcgttaaagcaatgtacctaaccaaacttttttcccactaagaaaataaaaatgataaaaaggatagttgggacacttccacttgggagcgtggcaacaatgtccaatctgttttatagtttggataactgactaatttcataagttaagacatagagttcccaaaaatggcacctaatcctatatacatcttagtggcgcttcgggacatatggcttctcttctatctccatgtcccatttttcctctccaaacttattccttctctttttttttcactatttaataattaatatctcttacacttgaaaatgtcacaaccaaaatttcctcgtagccaaagtagagaagaatcataggcaatacttcccataatttttagcatcagtcaccaataatcctgacaagaacatatgccaccatcaaaatggtgaaatctatttgaatctcgtaaaattatctgtcgattaacaatatttgatatgtatttgaaagcagtgtgacagtcaccacaaacccgaaggttcttaattatcctaataggtagctcagattggcgagtgagaacaaaagcaatcgctagtttctcactatgatagctgagaagctcttctttgttttcaagctcaagatcatagagtgcatatttggtttcaggcacatatcccaggtccctcattttgttcattatctccttgagtttatcatagattttttctttttctgggtgtgtttgatctccagccacaaacacatgaactccatccttcatggtgacccaactacacccagcttccttcttaactgctgcgttcctcattgccaacctagcctctgccacatcttcccacttcccaccagcagcatgcatgttagaaagaagcacatagttcactgcgttcagcggctctaactcaataagcatcttggcagccctacgccctagctctgtatttcggctattagctcgacaacatgctcctaaaattgttctccaaataagggcattaggattcattggcattgttttgatgaactcctccagcttcttaacattacctgcccgcccaaggaggtctaccatacaagagaagtgctctattcgaggagctagttcatatacttcacccattgatttgaaatgctcaaatccttcatcaactaaccctacatgactacaggctgataggaccccgacaaaggtaacatgatctggcaattggccatgctgtttcatttgtgtaaaaagcttaagagcttttcctccatgtccatggcgtgcataaccagaaatcattgaattccaagaatatatgttcctcacaggcatcaattcaaagaatcttgatgcataatctatctttccacattttgcatacatgtcaactagtgcactaccaacaacaacttcagattctaaacaagctcttatggcacatgcatggacttccataccacgctctaatgttgcaaccgaagcacaggcactaagaacagtagcaagcgtgaaatcatccaatctttggcccctttgcatcataagccataccaaatccatggccttatgcaggatgccattgtgtatatatccagaaatcatggcattccaactgacttcatctcttcgctcagacattctagaaaagataatctcacagtcctccatctgctcacactttccatagaaagctagaagtgtattctcaatagcattgtcatcagcgacagagtgctttaagattaaagcatgaatttgacggcccagttcaagaagagaaagagaagaaactgcagataaaatatttataaatgttactctgttgggtttccatccagcttgcatcatctccaggaaatattttatagcctgtaaaactgacgcctctgaagttgctagtgcaccaataaaagaattccaagaaacttgatcgtactctggcattagaaagaaaactttctgacattcccccatacaatcagtttcagcatataatgttagaagagcatttgaaactgaaacgtccaaatcaagcccgcatttgatcccttcaccgtgtatctgttgtcctaacatgatccaacccaaacttgcacatgaactcaaagtactaataactgagaattttgatggcaccattctatttctcctcattgtgtggtaacatgcaactgcttcctcaaatcgctcattgtggtcaaggccagagattatagagttccatgaaacagtatctttactgggtatgagttggaaaattgaccgagcattatcaatggcattgcattttgcatacatattcacaagagcatttccaatcaaaatccagacatcaaccatggcattgcgaatcagataagcatgaacctcttgaccctttctcttcccttcctttaaatttgaaaattcagtaaaagcacttaaaagaactgcataagatgatgcatttatttcaactaaatctttcatttccttgaatatcttagctgcttcttcaccctggtgctgccttgccagtccaaccattaacccattcatagtcactgcattacgatcacccatctgctcaaaaatcattttagcagaatctattaaaccataccttgcaaacccgctgaccaatgcactaccaacatacaaatcttgtacaaagctagatttttcaatcctggccagcatctgctcaagcaaagtcagtccacagtcaacccgagagcatgcaacagttactaagctacagaaggtatattcattaggcctgcagttaaattctgtagcttccctttgcatgcttaaaaatagcttaaaagcagaaattgcttctcccctacgacaatagactgaaatgatagaattccaggatgcagaagttttaatttttatttcatcaaaaacacgaagggcatcatcaatggaagctgagcaatgtgaatacatggacatgagcacattagacaacaccatgtctgaagcatacggagatttggaaattaagccatgaatctccatcccgagtttaagcttatttggaccaagctcctggcatgctcgaagagcactaccaatagcatagtggtttggtgagagaccagctgaaatgacccttctgaataacatacatgcctcatcaggcatgccattttgtgcatacccagaaaccaaacaagaccaagaaacgaggttcttttggggcatttcatcaaacagcttctgtgcggaaaccagattgccaactctgacaaatatgttgataagagtattacaccagaaaacatcactggtaagcccagttttgtagatctgcagatgaagctgatgggcatctttcacgctgcaagaatctttgtatcgattatagtccaaattcaaaggtggaaattggaggtgatggtgagatgagttgtagtaatgtagcaactgctctgacaaagctaactgggtagaacaagcatgacttgcattgtgtaacaatcgcctgtagcagagtatcatgcttttcgcaactctaactaggaaatcatttaaccgtttaatcacaggatgcttgtttacatgtaagtggagtaaaaaaaacaaaatgctgccattgcaaactcaaaattttgtaactgggaggggaacaagggttatagtgataaaagaagttatggttcgaatcttctggctgacttaacatactaattgtgaaaatttatcaataaaaataaaaaatttgtaacccctccaaattagtatagttatccttatgttcattatagatagaatagtttgatcaatatttaagtttgattattgataaaaaaaaaatatttaaattttatttatttttagtcgaattttaaattaattgttaaatcgaaggattaaaaataaaatatattataaacaacaaaactcaccttttgcatattaataaatcttacctatttaaaaaattcaaaacctatttgatatttatgaatgaaaagatacttcatttgatattataattttatataaatctaacatggactaaaataaactaatagaattaaaaaaaaaatactatataaagttaattataatctataaaaaaaaaatcactatgtctgatgataaataaataaactaagtttaaaaatatgatatgagtttatttttaatgtttaatctaactttgatgataatttatttaaaaaatctattttataataaaacttctaaagctgtatagtccatatttttaatcacctttttgttgttgttggcacgatattcttaataagtttttttcttttaaattaccatattctatatctttgaattgaatgacaataatttttgcaaaagaatttatatatctaaagtatttatttattataaattataaatataaaaaataaatatttaattgtgcaatttacaatctagaatactaaataggaagaaaaggtaaattagaataaagaagtgggtgcatggacgccaggtcattagctgggtagataagggtaggatccaagccaagagaagggaacatatgtgatgacattgcatttgcagcacacaaccatcaacatggctgccgagctcactctatcttctcccttttccttcaaaacttcatttctgccaaagtcaccatcattttccccaggttcatactcccccagaactaatgttaccgttgtcaaagttcatgctaaattaggtaacatacatgcaatcactcacttccctttgcttcagttctatgtaactattatcccatccttgtgaattaaatgaggttgagatgataaacttaggaatgtggatctgatcctattaggtggtggagatgaacaagccaagcaaggaggaaagaagaaattcataaccagagaagaagaaccacaacagtaacaattcataatttttattttttccatttccttaattttctggtcaccacgtatgtttcccaaagcctttctattgaatttgcgcaggtattggcagacagcaggagaaagggaaggagagaatcccatgaagacccctcttccttacattatcatatttggtatgtcaactccttttgtaatcttggcaattgcttttgcaaatggttggattaaggtacctgttcgatgagacagcacttcgttgtctactctactcctcgatcttcacatgttaattcacgaattttaagctctttacttctcattctcaaacttcagtagagaacttgtttactttttcacatatatgtatggacattatattatggctcgttgtaatgaactagagttcagtcctaccactatgaaagtcggattgaaaaagctacttcagagtagctgtagcagtttgataacccttgtacgtttttagattgaaaacaaaaggagaagaatcaagaacaaataaggtctttttttttttaccctgttggattcgctgcttcttgtttcaagaatagcacacgttgttgatcaatgcataatagttattttaatgaccgaacaccgaactgctaagatgagatggttgactgttacatggaaaattaacaaaggaatttagtggttcgagatttttatttctttctgctccttgtttataaaacaggaaaaagaaaaggcaaagaggtttagatcgttggtatactatagaactgcagttttttcatatttaggagaaatatatggttgacatctttatcatattaggttatttgcaatattcagacgtaatgatgtatagtgcaacagttgtacttaaaaattaaatatgaccttcgacactgagcaatctgtaacttttatagagagaaattattgcgagtaaaagtaaagaaatgtaatggtctgtggaattttaaccaatatgaaaaaaaggttagcctcatttatcagaagtagaaagtggtggaaacaagtgtactcagataacagtagtgctatgcatagtatgaacatttaggtgtcgaatttagctctctcccggggaggaattgccatttaacttctatatatctgtcccttattttaaagcatttaaatgactcttaatgtatgttcaagttcaaccatcgaaattacccatgatagaacctgggcatttgccatttggcaatgggtcggtttcagaagctgatgacatcatctgagagcacaacagagaagaggggaagaaagtcatagttcattagtgttagccattatatgctagagtaaccattggatcttcatcacagcatgtgcaataagctagcatatccaatttcaaattgtgagaccttgaaatcaacttgtcaactactacgggtatgttgcttataaaaaaacactactatgaaatgtattgtatatattgactgcggactgccagaataaaataatattcccttaagttttttacattgaaagcaatttttcatttacctattccaatcaattttctacacattagattaatgaccttaacaaatgttctcataaaggcagcttaaacgaggcaagttcaatagcaaacaaaaatcttaatgcttcatcatctttccctgcgtaaggacttgtacagttccgtagtaatatatttgtgttgaaacttataagttgatcgtagtgccccaaattgatccctatcagttttgtagatgtatagatgattcagttccaaatgcgtgggcctagggacaagacgactaccacttgcggatgaagaagcctcatgtcttattgccactggtagttgtggtggtaattctggcgggggcttgctgaactcctcttcatttaagtatgtgttatcataactcgatggtggtgatggaggatcttcaaaatcggagaagtttggaactatttctgggatataatcctgtaaaaatggtttaatcaagaagctaggtgaggctatctttgtatatatagatgaattgctcgagttgaagggattgtaagttatgaccatatttttgggatgttaattcattcaatacactattatgtaaacaaaattttctagcaatggatagaagactgttgaaatcaatctaaacaaagaaaagttacaatccattactatgaacttgcaaacttattctataagtgaggtcagagtcagagtcagaattcagaactagcattagttttttatttttttgttcagccagaactaccattaggtaaattagaaaggacacatatattcctaaatcttcccgtaagcaccgagcaattaacaaacaaggttgggacagtaacgtagaaattttctatctaccatgccatatgaaattctacttctgtgccaagcatgcagctctatagtctattctagtttagtatgagaccatccactcaggcatgatgagtttcctcatcagacaacaaattttgacaaaaaatgattcaacgtgtgactaaatggatttagtaagtactgctgaataaatattgtcaaaataaagccaaactgtcaactgaattgatgatcgtgttaaaggttatagtaaaagaaaacactggtgaagatgtaatcaacatgatcatcagcatttcctgaaaaataaactaataaagtaaaccatgaaattacctgcaaatccaatatattgtagccataacctgaatcatcagaagccgatgggaactctggagcatgtgtcaagtagccatctacaatgaaacggtaatgatagatacctatcgggagtgttttaacaatgacaaaattttgatctactctcatcagaggctccctgacaggacaaggtaaaaagttcatcatatcataagatgaagtaagagcaagaactatagttggaatttaaaattgtgtagattgttacgtggtctcccagctatcccatgatcctgcaatagcaacattcgtggctgcatggttccatgtgatcctcacacttttcagcctttcatgaatcacagattctacatatccattttgtggcaggggttgcgctaccgctgctggtctttgcatttgcatggcagccacagggaccttgaaaacaggcattttaaatttgatgttttaacgtaaacgttcattgtgttgtgccgctcaagatatttactgtcaaagtagcttcattcaatggcactaactattaacttgtacattcttcatcagattaaaagcattaaatccttattgtaattgcttaaatttttatatatattacctgggagtgaactaatgttgcaataacatgcatgtattaagtctcattataaatttcttcggccaatacatctcataacaattccctataggaccagcagtgtttcccatatgaatgataaacaaaattagtattcaaaatattaaatccaccttaaaattctaaaacttgaaagattactttgatctatgccctataacctaaaatctgattttagttgtaccatcccaattccacaaatcactattaaacggtaaaagcagtctagagaaggctgagaagcatcccaatttgataggatgcttatttcttactgctttgatcaaatttctttctttcccctcatggatacactgtataaaactataacattaaacacgacctgtcctatttatttttttcaataaaagacattaacaaaggatcatctaactctgacctggggttgtatgagcaagggaggtggtggctcatatggtccagggccatgtgaaggtaactgaaccaatggatctgtgaatccattagtattgccataaagcacttcaggtggcagaaatttgatgtcttgttcgtactcatcctttttaactccagaagtgccttcaccatcctttcctctgctgttactacccatcactgaaagtggaagaaacccagattttgatcgcacagcacgaatccattagatagagaagaaagaatcagaaagcaatatggcatatccatttcagtgcataaatagaagaaacccttgaaagcaaaccaggaattgactctaggtagaagagtggcattgttgttatagaaaaaaaaaatagtttttttttgctttattttaatatttgatgagcctctcactctctttctctctctgaggatgccacttttccctgccttaaagcaactgaacaagcaagtatacagggttttattctccaatgaatttggaagattccgctgtggactaattattatgagtctggtttaaaggagaatgttcccctgctatcaggaacaaccaaacactgtctaatgaaacagtgcatactttttgcacagtttcttgtccctgtgccggtccattaaattaaattaattaaatttctgtttgtaaagcaaagcaatctaacactacagaatattggttcggtaccataatggattacaccagctaaacgaacttgttttcagcgtaatggtattgaagtcaaaagctcgtaacttgctacttgttactattattgtcaactaaactcataaaatggcatcttctaaaaaaataaagaaaaaagaaaatcataaaatagcatccattgttttgtgcttcctgtctatacaggaaaacatgagttgttggattggatttgacatgttagctttgtcttttttctattttgtttgcaacttcttgtcttgcataataaaggttaatcatttcaatactagtgcacttcttttgccaatgacaagagtactgcacatcgacaacccatcccatgaatagaaaaataaaagcctgctccgtcctcttggttgaagtttgatggttcaatttcacgatatactagaaaacaatatgacactaaatcaatagtttatgaaaatataatattaaatcaataatttctatttcaaccctattgtcaatttagtataatatacatattccttgtgaggaataaattattttttgttgcaaaggatatagagaaagggatcggtacctgtgagccaaccactgtatttcatattcatgtttgtatgttgtgattatttttatttagttacaagtaatgggtaatcagctgttttatatcatatagtacatcgtatcggataaacaatgcataaagagggctttcttgtattagaattcactaggactaggctcttgttatcgaatccaacgacggttttatctttttctaatgcgtctgctcccttgaaacgaacaagaaattgcgccatcatggctttatgttagagcactctttctgcagggatgttacaatacacttcattggaaattggccccttgaaccatttttttccgtctacaatttcatagctgtaccaaataattatattatagtcgcttcaatcctcaaatagatgtagacctattggctataacctataagggaaaaatcatgtatgtaaagtgaatgagtaaaattaattatatttatttttaagattatttaatacgtacgtcaaaatcatgatggattattaaattaaggattatttcactcttaatcgttttaagcaaaaactcactttcaaggggcattttctaatgtataataataatgaaaattaaccaagggctttcattttctacccttctcctgttctcctatagggttattaacattgatgcatcctataaagtatatatgcttagtgaaagggtgccaaacccaaataaattctccagggacaaaaagtagatacatacggatcttttccattatatagctgcttttggaatttaagatgcaaccatagcatcccaagattccaaagttcaaacaaccatgtgaaaagctaagtaaaagcatcaatagattcttgtttaggccttttgaagttatacaagtagctcctgcgtgcccttcatcaattccacccaactttagcaaggcctctatgtccaagtccccaaagtatctaccttcccatgtggtttgttttatatttccaaaaggagtcagcataataggtactagttgagcatgtcttaatccactaaagctcgtgagagcaaattatggaggaagtgggcatctccttttaagcatccaatcaatgataacaagctcaaagtaaaacagatggtagcatactttaatagtttcacagttacttgctaggtgtcaactaaacattacataataatctaacaaggatcattatcttcaaagtttacagttttttttttttttaaaacaggtggaaaggtttgtaaaatttgttacttcatagttattactatatgctagcatagatttggtagttgtttgatgcatgatggacaatcatatgttctgtggtttgattcagaccccatttccttcataaagctaatcaactagatattcctccattcccacatgttcgtcaccaaccactgaataattaattaatcgagcaacaactctacgagtgaattaatatttgaacattcattttaataaaattgggagctccgtcaaatttgtgtagtggaagttataaaaatcctttctcaatcttcgttattttcatgaaatttctcacctataaaaaatttaatataaacaaggtgtttatgtttgattgagtaaatttaggatgaaaagaaaatgaaaaaataagccaattttctatgacaagaaaaaataaaaggaaaataaatgagtctcaaaaattgaaaaaatgctcaatcaatcaatcatgttgttgctccatccagtgtaacatgcttgtaataaaatatgaaatgatatgaaaaaatcttcaccaataagtcataaatcaatcacataaataaattggacatcacatctaactcaaagttttaaaacattagatatataaattcttattacttgtacgttgttcaacatactaatcacgttaacatgacttgtattaagaaatgaacatatttgttgctcttagatattgcatcaaaccaattgtcaaagggattaatggagaattatacctatgttcatgttaaagaacacactcattgaggagttataaagtcagttaagaactcaagaaatccaataaggtgtactatgcatggcttgtcatgatcaaggaaaatcacacctatttatagaatatttcttctaatcgtcttgtaatggttcttgcccttttttagggatgacatgtattagtgaaaggaaggaggtgtttattgtgccttaatcatgtaaaggtgaaactaatttagggatgacatgtattacttgattatgtattagagttaggtccatcaaaggacatatttgtgactatgactaaacctttatctttatcattctaatttatagtttgtaaacatttattatttattattagatcaaatggttttttttaataatttcatctgaaaatctattattcttcatcaaccgttaaacttaaaagacatagatgcttgttagtcttaatccatgatactatttatttctctcaataaaatagaagaatcatattttgttatgaagtttattaattgggcttgtgacgcatactcagtaaggggggaaacgccaaaacatcattatcttgccttatggaataagcaacttaaatagttgtctgcttcttggcaaagttgtgaaaatttattttattttatattctctctttttaggttaatttattgttaaagtcttctacgggcatttgcattgtaagcaaaaatgtcaagagagtgactttgaaataaaatatgattttgtaatttacacaataagatcggtcaaataaagaagcatgatagccaaaaggccaaaataacaaatttgaactaagcaaatgataaacaagcaagttgctgcctgaatagttgtttatatatatatatatatatggcttaattattagtccttgaatttgaggtgtgtaattttttagtctttgaaatttaaaaactattttttttaatccctaaattttgaaaattacatttttttaagtcccttacataataaattgacactttataatgatttttagttgttttaaattaatttttatttttgattaatttgaatttgcatttaaaaactatcataaagtgttaaaaaaatttgtcataaagtacttaaaaattatcacaaaatatcaatttattatgtcagaactataaaaagtaatttttcaaaattcagtgattaaaaaaatatttttaaatttcaagaacaaaaaaattacacaccaaactcaaagatatataaatataaatatagtatgaataatatgagaatactcttatataatcataaaaggaatttttataaacatgtgaacaacgaatttaagattaaaaatagttagttaagatgaaagtatttataaattcaaattaaaatttaatataatcataaaatctttaaaagattttttttttaaaaatcaaacctataagtttgttataaaattcttttaataatgggtcttagttgaatgctaacacagtgattgaaaatttggaaaatttacattgtatttagggattcacatctcaactacaatacaaattaaacaagatcgtatataggttattatatatatttttaaagccaacattttttattttattataatcatgtctcagttttagcacaagaagtgccatacacgaagccaaaaatctgctcacaacagaatacctcacctctttcgaaaaggcaatacatagagacatcctcccgaaaatgaaatatgctacaaagccacaaacatctatttttcctccatttacaaaaaatataatctaaacgagactatgctccccccaacacaacaaaagatatccatcgtatttttacatctaacttttctttcattgtatttctatctcatttttatatttctttattatttttaatcatatttgtcacgtcaatcatttctctctctctctctcacttatacattccaaaaatggaatatacattaaacttttacacacacacaaatatatcaaacaaaactcttcttactatacaaaataagaactataaatacagattatcaaatcatatttcaattttaaagttttaaaaaaatatctatacgactttttaaaatgattatgtgtgatcaccaactatttttttaataatcaataattaattgtatcatatttaatttgtttttcatataaatgtattttttatttgttcttagattatttcaaaatggacataattatgaatattttgaatgaaacttgatgtttctatatttattggatgaactttaatttttatgattagctttcttatcatctatttcatgacatatcacacataaataaagttgaattttttgttgttgttagaattaatgttacttgaagatttgaactcatgattttttttactattttcccttcaatctttaaatcatttttttcaacatcaaatcaacattataactctttttaaagttgaactttttccctaacttcgataataccataggcataaaacattattatgtaattaactttagaagtatggtcacgaattatcatcttcttagcaaggaatgttaaggtttgaattttgatccattttgtagaaacatgcacgattcgtttatcaccatacgtcacttaattggtaactttgaattttctcaatccttcgaatgccagctttcatactacaaataaaaaggatattgacgcataagctttggattcaaagcaaggatgttctataagctccgtggttagaataaaacaggtaataaacattataatatggtatgttaaacatttttcaaatgaaattcatgattagtggcaaaacatcccctatttccatccctcttcatgacaatagagtagtcgaattttctttcttgtgtttctttttcaagaataaagttatattctcaaatcccaaaaataaagtatttataaaattgtgtcacacgtggtcttatttctataaataaaggatcaatggtaaatgatttttttattataaaggacaatgactacatcaatcatatttgtataaatgagagattaacaagaaaatttgtttttaagggatcgaaagtatatttaatttattttacttgcaaagattaaaaacatttaattttttttatagtaacatatttaactttaattaattaattagagagtttaagagtgagaattttgataatgtgttataaaacattcacttttttacgcaaatgactatatgtacaaatggtttgcaaggggcatcattaagttgttgctttataacccaaatagcttgaacttgagtagccagcccattgaagcctggacccggtttatgattctccttctttaatattaactgggcctagtaaatcatggatctagagtaccaaaatagcaccttttaaatatgtgcttgtttggacccaaaacataaaaaaccgtaccttgcccttgctcctccatatctatgctgtgacaaatattcatatgtcctcatctcgaattctcacacagaacttcgaaccttgccctaaatagaaacgtacttgaattccacattatattttctggtatcagcatactaactagaggggaatggaggtacatctagttgtcatcttataaacataactgattcatttttttcccctttgggtccataattacctgattttagacaacttattgcatcaattcataaacctatgctagtgggatacctattatatatcaaaccaactttgctttaacttgcttcattgtagaagctagatctagcatacaagtttcttatgtattttgtagctggcttgttccgttcaaactttcttaaatcttgagcatcaccttatctcttttggctgacattgttgcagttaattttaactttgtttacttatcctaaaaccaaaaacaaagaaacgaatcaaatgtccttgggtagcttttataactttcttttgagtaagacactgtttactccgttcttaattgagcaacaaccttactgttaaatattgaaacagtacaactattggttgccccacaatgatgctatttgatgctttttattccaaatttggtggctcggcctttaattattgcaaggatgagggtgacaactatgtatcaaccaatgtaaaacataaatttatttgtcacgaacaatgatggagcccttttcactaggaaaaataaaatgcttgaactggtttattggaatattgagccaaattgtcccaactggcaaaagattttggtctttataaatgattttgccaccaataataatttcaacgtgttctccagaggactgccgtcattaatattacgcaaaacacaatttaaaacatagatatacattagataggggctcctgcacacttgcacatattatacatttttcccaattatctggctcgcattacagtaccctatctaaggatgatgattaaatttaatacacatctataaaaattgtctataatggataatatttttacctattcatgtaggttttaatctagatatgataaattttttttgctgactttattcacagaatttttgtagataagtaagtgtatgagtacaataatacttttttttaatagtacattaatactataataactgaatcacttcatgtatatactcatattttttttaatcatataattagtgcgaagtatgcaagtatatatacatatatattataattaggatttaaaatattttatatatttttaattaagttagatgttatactatttattattatttttgttttattaattacatataatttttctaaaaaagtcatataatttttaatatttattttatttatttgtcaaaaaataaatattttttttattgagaatgaacaccgacactaaaattattacctttacaaatataaactaaagtacggatttttatttttaaaaatacaagtgtaaatcactcgtcttgaatccttctcggttattgttcaaaatgtatgtattatacgagatattttaaaatgaaatgaccttttgagagaatttaagtcaaaattcttactaaaaaatacatttcactcagcagctagccgaaaatcaaatgttatattaaattaaaatttatgatcatactatattataaaataaccacgttgaaggatcaaaagaaaactattatgttttttttactaaaaaaagttgtttttgctgcttatctttgaacaactttattaaagtcccacgtaatgaatcataaattaatgctaaatgaacataaaatttattcgttaaactaaaactacaaataatctcttaattaaacaaaataacataaaatttattatattatgaacaattaaaacactatttcatgaaatatattttctttttatttgatattttttagttttttaatctgaaagtatgtaataaatattttttttcataaaaaataattaattaataacattataattttatttcatttcactttatgctatattttattctatttatttccacattttattaaaaacatatgcaaacatgattgtagatttgctagtgcgatgataaaatttgattttgcccattttggatttacgtaaattaatagtatttggtgttttttttattgagaaaaatttcaacgtcaagaatgctttcagcaaattaaatctcaaaggtacaggacagtgtgatatttgtcgtcatcgttaacaaacgttttgtaacattttttttaatacgcttttctatcatcaaataaaaattataaaattttatagatttcgcttcttactcaatattttaaatttattaaatactccttaatatgtatatgttaaccttgaacactaacacttttagatcgaaaatagtaccagagagcgagcatccaaattccaaactcctcttataattttaagtttaattttttttcttgcaattcagttttttagtttttttttccttataactttttttaaagaataaaaaataaaataaacataatttataagaactaaaaattaaaaaaataatttataaaaataaaaaattctaaattatcaaaattaaaaatatatttaaattataattttatttaatacaaacaaatattggcaactgtacttaaaagaggaaataaaaatcgtgaaactgacatgtacattagtggggagtggggcctaagagcgtcggtgggatgcggatgcccaattgctcaattagcccactttgccctttaatactatctcatctcatattccagaaagagtatataatactatctcatacactgttttatacaatactttttacttacttatttattatatctcatattcctctttcttaattatataatttacaatttcatatttctctcttaattgtataatttatcacaagagtactatttttcttcaaaagaattactatttttataccactcttcaaaaagttattaaatactactaattcaaaactttatgtatccatgattctttctaatcttcacatttcattttgtcggaagtattagttgatttggttgatgattaacttttatccaagaaatttgaacaactaattttaatgaaaatgttttctctcaattacatcaaaaaaatgtatttatagattgtttattaacaaaaaattctcatattgatatatggatatgattcttaccgaatgaactaactttgttggttctaattattaattttcttctaaattaaaaactcaaacacgtattataatataaatattataaaaaagtggggccaattaaattagttatcttaatagaattgtcaaaataatggaggatggggtccatctcgaagccaatcccaagctggcattaatagtatgccttctcctcataaacggacatgctgctttagttataaacccacacactcctctcttctccattctccactctccctctctctttctttccctaatcctccaaacaaaatgaagaacctcttctctctcttcctcttcctcttcttagcctcctccgccgtcgccaccgtccccgcccacaacatcacgcacatgctggccaaacaccccggcttctccaccttcaaccactacctctccctcacccacctggccgaagagatcaaccgccgccagaccatcaccgtcctggccctcgacaatgccgccatgtcctccctcctcgacaagcacctctccctccccaccatcaaaaacgtcctctctctccacatcctcgtcgactacttcggcgccaaaaagctccaccagatcaacaacagcaccaccctcgtctcctccatgttccaggctaccggctccgcctccggcaccgccggctacgtcaacatcaccaacctcaaggccggcaaggtcggcttcgccgccgaagacaacgacggctccctccactccttctacgtcaaatccgtccaggaaatgccctactacatctccgtcctccaaatcagcgcccccattagctccgccgacgccgaggcccccaccgccgccccctcggacatcgacctgatctccattatgtccaaacaaggctgcaaggccttcgcggaccttctaagaggctccaaagcccttccatctttcaaggaaaacgttgacggcggcttaacggttttctgccccaccgacagcgccgtcagcggtttcgcgccaaagtacaagaacctcaccgaagcacagaaggtttcacttctgttataccacgcgactcccgtttacgagtccctgcagatgctcaagtccagcaacggcatcatgaacactctggccaccgagggagcgaacaagtacgacttcacggtgcagagtgaaggagaagacgtgaacctgaagaccaaagtcaacacggccagcatagtggggacattgatagatcaagatcccttcgtggcttataagataaacagggtcttgatgcccagagagctattcaagcccagcgatgccaaagaccaagaccaagcacctgccgagtcgcctaagcctgccaagaagaagaagaacgctaagaagggggccgccgattccgatgcggcggatgcaccggcggacggaccatcggatgattcccaagatcagaaggctgccgatgaagacagcaatggagtaagcggattgcacgtgagattcctcatggtcttcttcggtttaattatgggctttttggctctatgaaacacccatacatatggattatggagtgtcggtactatacacttgtggtcaaccatcattgcaattaagattcttttctttctttaatatatgtgaaggaaataaaacgctgccaccgacacatgtaggaggccatgtgtacttctttctttcttttttttttaatctgttagtattataggttttgtatttattgtttgtttgttttccgaattatttaattggcctttttttccagtgtgggtagatccggtttgtgctacctgccagctatgggatgtgtgcatataaacagttttcaattcattagattttgatatcaatattcgcccctcatgttttctttattattgttattatgctacttgtcttaatttccgcggtcacccaattagtagttcataataatctatgtttttcggacaccattaatatattttaattttctaagacattaagctcggattttgtactgtaatacgacattggcttaaggtttgaacttgctactgcttatgagttacttaaatcatcttcaatcggatttttcaagtgaataagatatgtatctcaaaaataatatattttctctattataacaagtccatgtgataatgaaaatagatatgtattttttataagaaattattttttaataataaaaaataatatttatctgacccataataatgttataattaaaccataattaaataaaatataaaaatatgaattttttaaaattttctagaatttctcatcattaaagaaaaattatttataactttttttataatgatatgacactttgaaaataaaaaaaaaaataatataaaaattataaaaaataacttaaaaaattctcattaaatatcctcttatcatcttatcactatttcagttctagtagcaacttgaattaagagaagcttatatagcgaggtaaccttttttttgctgtaatttaattaaatttcttacagtttcctttttatttaaatgtttaacggcattttcctctaactgaatgatagaattttaaaaatatggcccacccatcgatcaaacttgtaccttatactgattatgcagtggcagagcattttaatcccaaggagatattgttttccaaaagtgataaaagaaattgaaaaatcaaggtttaaaaattttagtcgcaatatcataattttggaggctttctaaacagcaattattgcggtagctgctcaagttgtcctcaattttttattttttagttttgataatcataacgtaatttcaaatccgataccgatagcatccacaatttaaaactgaaatgaaaataaaaaatcagaaattatcagagtcctgaaccaaaccagtacatgatgtatggtcctgatcaaatcactatatgagactaatcagtattattaatcaagctaaatattggacacttaggccaagcccatttcatatttatatcaaattggttttgatccactaatgttaagatttaaagcttcttctacagagaatttgacaaaatagaactgagtttcgaaaagttgacaaaaaaaatatttatgcgtgttaggggggtgagaaggatgaaggatctcccattaactttgcagctgagtgtcatatttcttgacattaagtgagtcattaaagtaattgcatagacaaagattatacaaatttgcaaagaacagaacataatcagcggtgaatcggtgatggctaaagattggaagaaactttgtactagtgtgtattttagagaaactcggttagtgctagtgcgacgtcttccttcccagtatccatgtattgaattgaatgtaacctttggctcgagtcctaatcggttctgtataggagatctgtagctgctttattagctactttattacattccacaacggatagtgtaaaccgatatccgttatatgcagatacaaatttacttcagcaccatcactagtcttttcacctgtcttcattttttaacattcatggatatctatgggtattcgctggtatacaaaaatccacaggtagttgaattcgaggatatgcgtgaattcacgggacgggtacggacagattttctaactcgcggagcatgtaacacgtgcccctatctagtggtcaattcacaacaaccaaagtatttgacttgttcattacataatttttgcggtgaacaaagggagcaaagttcaatgtgctgcagagggtgaatacatcctcgttgccaagaattcttttcaccctcaagattacaattttctataagcaaaaccaggatggagctgtatagccggaaatattgcagatatgagaaagaaaacgttgccaagaattgcgaatgggaactttgaactatagtttcacttatatagtatttataaaagagaccatcactgcaatgtgcctacaattttcaagtctcggaaccgaaccattttaaagtaactcagtctggtgtctgcagctgccaaatcagcgctataaacacgggatcaagatcccctgcagttttttcttttccaactgcatgaatctcaattctcaatcattaatatatatttctacttgaataaaattttgatagaaaaacataattaaaaaagaatggattgtgaaagattgaactgcaccactgcacggatgttactgcatgacctacagttacttattaaatgctgagaatcctagtccatctcttctgaacctgagactttcggatgaaaccgtacaaaacaccagaaaaaaaatcctcgtactaacagaagtgcatgttctttttagcatcttattctactagcctacacttattttccacctcaaaaatttctgatccaagattaggggtcccagatttcaaaaacaactttcttatatgacatcatccccattaaaaaaatgccgtatatgttcaacttaatattttggctttagctctcggctctaagaagtgaattagaaaatcggcagtcctctacacaataatagatgacattataaaattaacaaacagtagaatggcaccatattttatccttattgaagacataaaattcaggttccggatgcacctggaaaaagtactaacaaataaagttacgtatacagcttgaagtaagtactattaacaaataaagtttgagtatgatatataaatacctctatatatcaaacattttattaacatctattatttcagtctatttttctctttttatcacaaagtattatatatactttatctgtcttttctctctttatctatctaggatctaggtgtctactagagtttgctgtccacaaatgttgttccacaaagtttacaagtatatgtaacggcaacttgcaagcatatacatgtcaatcttgctcctgtttggaagctaacaaaaggctggcatcccggttgttaaaatacagatgggtctttttgccagaagatgtacaagtaagcacgttagaaaaaccggtgtagttgccatccagctttgaaatgcatatttttctaataaagtcaaaaagctcattttcttgcacaaaaggctgggcagcataatcttcaactggcatccactgaatgaaaaaaacgagacaccagttaaataattacagaaattacaaagtttcctggtaccaatgtcttgatagattatcagcatgtagccttcattgacttggagagatttaaaatgaagtatgaacttaagcaacattttagggtgcgtttggtttgttatttattttcattttaggagtaattaataattaacagagtgaaaggtgaaaataatatggtatttctttagttatacttaaagacatgtcaactgaaaattagtgagattctcaattgacattagaatatataccttcgctgcctcaatttctgaagcctgattctgaatgtcaaacgattgaggttgcaacatgcaaacaaagaacaaatctgatttctcgaagaacgacttatggctttgcctagtacaaaagaaataaaggtcggtgaacgtgaaggccacattcaatattaattcagatttcagagagaaaaatagtgtaaattatatgcatagcagtatgttggttatttgtggaaaaaaacgcattcacaccacatattacctgaatgctaaaacttcaacaaactttgtttctatctgaaaaaagaatgaaagtaatggcattagactttgaaacaatccaaaaaacatgtaatatataagctatagataaaattacaaccaagtttgtcaaaacagcaaacccaaaacttggtcgatattagttgaataatttgaattaaaatttactaagtaatattatttaattttaaatatttatattgtcacatgcataaaaatatagtgtaattatgaaatttcaagatttcagaggagtttaaggtttgtaaggaataaattctgagaaaaattaagaaaatccatttttttttttttgacaaaacagagaagcataggcctttatttttggggtcaaattggaatcagtctttgattataagcaaaagagcaagggaacataataaaaaaaaggaagggtcttaatcgtatattagatatttactaaagcatgataattgataaaatattaaatacacatgaatgccagtttttatgatattcattaaattattttatttttacatttaaaaattaagtttgtaaggaaaataataaaattttaaaaaatgttgtatataaatcttactgatattgttttttttttcttaaaaaaatacataacagtgttagctaaataattagtgacagagaaaaatataaagtggattgtaaattatagttgagttcggggtttgctattattttgacaaatttcaagtggaatgtaatttactctaaactataaattatgtgtttgcttgcttacccccgtctcttctttgacttctctaattgcagcttcacagagatcttcaccctgcaagtggatttgaaacatatcaaaagataattttagaagtttaataatttggtcggtaataattttgacatactttctgtccaaaaataataataataattttgacatacttcattaacagctcctgttggcatcttccatacacctgtgcctctgaatttgccacctgtttcctgaaccacaagcacctgtcaaatgaaacaagatcatttcaaaggtttcctcctttattcaggcttcaaagcttggacttcaaattgaaaaagaaataaagaaaagattacctctttgttattgttgatgacaaaagcaccaacaccgacacgatgtgaagcatttgcaggaatggtatgaggagtatctggaatccaacggaccagcatcaagtaatctggctcagcatggtggtacctaaatccagcctgaaaaaggagcacaaaatttgtagcaaaatggcttcttaattaagagttaggcttaggcaaataaatgataataaaatgtatgtttaccttgactgcaggatcaacaagatttgaatgttgtatgggcaacttgatccagacccccttcttgccctgttggctccacttgtagattgaagcttgcaatatagaagagaagagcgtagaatccatagggtcttggacgtctacaacgactcctccatgatgatcctcaactccactgagcaattcaatcttttcaccttccatttggttgtgtagctcttctcttgtaatatatatatatatatatatatttgcagacaatgaggggatgagatgagatgataggaacaaacaacgtatatataattaattttggagaatggatggaaggaaggaaggtatgtaaactgaaaatcaaaggtagtgatgaggaaatttcattttggtggttttcttttcttgaccctttactttcccattcaacatttctaatacggagacaggtgaatcaccgtcccatttttccatgagcacggcggtgtcattgacctgttgcggctcaaagtacagccaagccgtcgaggaagtcatcaattattcaattacttccataattgtttttttctacggactctaaattaaataataataaagatttaagaatgaccttttcttctacaatgtttttctcctttaattcttcttaatttctctgttcttgtgtgcttgtttttctaaaagttaaattactttctaagttcctaaattatttagcaatttaaaattaagttcttgaattattttcttaattaggagatgaaaaattaataatatgaacttaattaaaaaaagtcaaaaatctagtttagttaattaagtagaatgtataagttattataaaccttttaatatgtattcaattctcacatattaaaactcaaagatgttttgttttttttttttatatatagatcttcaaatatacttagctgataatatttggaagcataatttaatcaattctaaaaatcttttaagagaaaatatataaacatataatattaaaatgaattatgtatttaaatttgaggggttttacaataaaggatttccctatagttaaccattaaattaaaaagaagtaaattacattaattatttttgagattttatgaaattatacaattttttatatgtttttaacatttataataatctcaattttcttatgtataggaacaagatgtaatattttttaaataattaaaagaatctaagtaacgtataaggggacgtcaacgtaaacttttaaaaataattaaggggttagtataaggattaaaaaataagaggatctgtgtaactttacaaaatcttaggcgtgttgcgtgtaatgtaatttattcattgaagaatcaaaggttaaacttgtgatattataaataagtgtatttgtgaagttatgaaaatactaacagttcattttaatataattagtagatgctatagataattatgaaaaacccttatataatagaaagagaaaaaaaatactaacaagtattttaatagtaattaaggagttaaagttagaaaaaattacaaaaaaatacattatttaatgttagcagcaatttattttcataataattttcaaaacaatgtctttctgtttattagtttcaattgaatacttggtagcaagactttaaaaaagttaaaagcgattagacaaaaaattcaattaaaaataaatataattttaaggatccaattgaaaaaaaaaaattagaacctaattaaaaattgttaaatagttaaagagcctatagaataattgaacgtaattaaaattcatacggcctattaaacaaagtgagttattctctatttaatttaatgaatcttaaacctcaatttaattaaaaattacttaacttataactaataataaagttaaaagtaatatataaaaatgtaatgctggattcctcttgataaaacttagtttttgtatccaatagaataatattttgctattaaacaaaaattgtaaattgtaaacttacgtgtttttgtgttgctcgtgctgctttgcagtatttcaaacagcccaaatggcatgtttgtaacatcaatagctaaactaaggttaaatgaacaagaaaacttgaaaagtaaacagcattgaaaattgacatcaacataaaagcatgatctctgaaacgctaattattttagccagaaatccatcattatcatcttttccagctttttatagtatattattctattttcgtttaaagttgtaccttgatggcagcgcctagagcatccaacaaatttccatctgaactaacaacaagcccatcaatgtaaggatcccaacaaatttttccttcaacgagaataagcgaggagaggtcaattccagcacctgaggggaaaaaaacaagagctcaacagctatattaaaaagaggcaacaacatggaagggaaagcatatggtagtaagcataatcttcactctaggagaaaatagacctgctccacttttaaaactatttaaagcaaaaagtaaaaaaaataatgtctgccagggtttaataatcagaataccctgccaaatgtcaactgattaaagcctagcccggggaataacttcagtttcaacagagattagttgatatgtcaatctctttctaccatcacaacgaagatcttgaggaatgaaatgtttttctcaaagagataaacccaccattcctgcaaaagtaagatttttttctctgagaaatttcataactaaaaagtacaaagcggaacagtcaagtaaagtgttgttaaaccaggatagcagtgtaccaccctgttacagtctaagtagtaagtatatactttctgattatccatgttatgcttgcaggagggtcttagtaataaagttaaatcctttctcaattgaaaattcttattacttatgtacaccttagtagcatgcatcccttcatttggaaccatatactctaataaagtgatttcccaacctgcctatgagttaccacacaacagaaagtcattaacttgaaaataaggaaaccaatcctaactcaggtatctcaaatgcttgtcatcattatctatttcttccactgatttctcgaacacagtcactttctatatacaggagattaaaaaaataaacttaaagtcaagtgttctagcagctactttttacacaaagaattaggattattagacaaaacacaaataattggtctcagaacttaaattaaaaaggcaggccccatatctggagcactagcatgccatatcacaagcactcataatagagaagagagaatttacaattacaggacctgatttttcttctaaacttcaatttgaaatcaaaatacctgaaaccaatcatgataatatttacaaagcatttgaagacctaaatggcattcctaagtctaaacacaataaggagttggcgaaactacatcagataaaaaaggaacaaagagaaaactcctagaaaagaataattactaataacagcaagcattcacaatcacaggcgtataaagaaaggcataaaaataaaagaaccatttagctagcatattaatggcatagatagaagatggaaatctgaaattgttatgaacctgaattggtgaaattagaaagtgaatgatagttagattactagtttcataaaattggattatgagtttgactagaaaatattcttagaatttgaacggaatgaatttactctttccagtgactttgaattttgaagcacacaatgcatgagaggagaggtttgaagctgataatgggctccacaaacctaaagacatagcagcgtgtttcaggtttcggagtctgacagggaaatccaaaaaaaaaaaaaaaaatactcgttctgtcaaaaatactcgtttattaaaaatcatctattttaattttagtgggttacacttatcattgattctttctcatagattctttcttttgatttagacatgagatctaccaaaattaataattttaaaaaatattagtcgatcacaaagagtatgtcatagataatatttttaactttcttcttttaattttgttgtggtgttgtttgaaattgaatgaatggaaattgttctctattaatttagctatcaatttccgcggttgagcttgagccttcggtgatgttagttaaagttagctttaaatgattatatgaatataaattattagaaattgagtgagggatatggtgagtgtaatctgcaagggaaaattttctttttttccccagttgctgaaagtaaggaccgaggtagtaggagatatttgcttcgtaatgttctgttggaatgcatcaatacgtgagtgactacattgcttggtaaatggtaattgagaaatcgtgatgccgatagtgcattggatttggagtggaagctttgaataaggaatgcgttcgtggggccatgtctttgaaataaattgctgataatatagatttcttatttataagatataattctaaaaggaaaaaaaatcaaggtaaacatatttttatcatacacgttttaagtattgatttttagacttttataagtattttatttatttatttaagtgatattgaaagcttaaaagaaattgtatctatcattgttgaaaatgacttttttttttttaaaaagtaatgcttgtgttctataatatataaatatatttatgttctgttgtataaatatatttatacaaaaatacttttacatttatgataataatttaacaaaatatacaaactttcatgttgttgatataaaaaagaagaaagtggaaagaaaaagatttcacaaaaatgaagctttgtaccgtgggaaaataataaataattattctaggagtgagacacataaaagattcatatgatatcattttaatatttaaaagactaatttgatagtaattttgaatttgaaaagaataatagcgtggcatagttaggttaacagttagaagaataaattgaaggtttgtcatttatgacatttgtggcttagacataaattgaaggcaattagtgattaatggcaaacggtgaaaaactacaagagatagaagagccttacacgcaccgtgttgtggcctctttccgttttttgtcgttaacaccgaaactgaagcaaaagtcagttacttgcactgtttcatttaaaacttacaagcaacaacatccttgtacctctttcattcttactatgcctttggccgcgtatgtataatataacaacattttttccttctggttgttggtactaggcaaatgataaaaaaatctcagtgtaagtatgctagtaattggaaaggtttgctgaatctgtattcgctcaagtaaagaggcaacaggtacaataattttgattccatgctaaatctgttcaattttcatgcaagttgctcaactaattaatttgttcaagaccaaatgaatattcgttgttgtaaattactatattgagtttatacaatattgttgttgtctctcgtgtttaatacgactactaattgcttctggtcatttcatattcattcaatgaaatagctgatatcaaacactaagtatggttggcagtatcttttgtttgattttactttttttatgcctgatataatatgtgacaagttctctgtaatagaatccatcatttttttgcttgattggttaatttgtcatgatgcatattccccattagcaacatttttctttcttcgaaaccgtcaaaatcatgcttcaccaagttcaactgtagtatatgatgaggctaccatcttgctgctggttccattttaggtatcagagttttggatgacccgctttctttttcttctccctctgttttctttttaaacactttataatctaattggtttcaccttaacataatgtgctgaatctgcatgtgggctaattccaaacatctcgtacttcaagttctattccttctgtgcaaaaacaaaattggtggggggaattgtatttttttaattaaaactacctttgtcgactagtcacgaggtaaaatcaagtcaaaataaaaaaaatatacgcgttttagatgagcactataattcaagcttctgaaatttctaactgtagcacaagtaatttaggagatataaggttaatctagtggttggggaaggatgaagggagaagagagggaggagagatcgcgggtataaatctctcaattaacatttctaacaaaactaacaaattaacattcgccgataaaaaaatatcaagtacacaaatatctgatcttgttggtgttcggcatgtgctatctctttttcttaccgtttatccttgtgtttctttttaaggtgacttcatctcatcttagacaacagaaacaatggcaatgcagggttgttattgtcactatacgaagttggcaactcaaagaagaacactggacaatctcagtttttcaggctcaatttcggttaacaaattgtcaaagaatgaaaggaccagaacatgtgatccattatcatcagggaacaatcaattttataggttaccggtgaaaatgcgacagacagaaatgcctgcctcaaagtatggaacaaatggtaaagctgttagaatggtagggacaaatgagttagtgaaaagaaagagaatgttagagaataaggtggtgaatggttcagcaacttcaaaggaagtgagaaaaaatggtatcccaggcttgaccaagacagtgaaatctagaaggtcattggaagagctaaaggttttagccacagatgaaggtttcagttgggccaatgaaaattacagttcctggcagaggtctattgatgtttggtcttttgtggcttctttacgtattcggattctgttggacaatgcaaaatggacatatttcggaggtttcacagaggcaaagcaggtaggttctcaaggttcggttcttttcttgctaaatttaaaatactagtattttccatttatttaaattggccatgtttctttttgctgacctgaatttttttaatatttttatttagaaaagcagaaggcggaaaactgcctcatggttaaggaagtgtatattgcagcttggtccaactttcattaaacttggtcagttatcatcaacaaggtcagatctatttccacgtcaatttgtggatgagctcgcaaaattgcaggtatctctgtagattttgtttttctcattttcagactcatcattgtagatttgtagagattcccccttttttttgttttttttttttttaaagaagacgaagaaaggtgcttaattttgtcatctattctacttatctcattcaaaaaaaattctcttagactatcctttattaaaattcgatataagaaattattgaaaataaaattttaattaaataaaacttattctgaaaataacttcgttaaataaaatgaattaagatttgcttgtatttttaatcaatatacatgagggtttttttccctatattcaagaccagaaagtaattcttatttcttaatataacattatacaggacatggttcctgccttctctcctaagaaagcaagaaaattcatcgagagtgaattgggagctcccattaacatattatttgaggagtttgaagatcggccaattgctgctgctagtctcggtcaggtgtttgaatctagcccagctcattccattatatttattattttggttaaattaaaaaggataaagtatctttctgtttattacattttcataaaattattaatattaatttgattcctgtaaaaataaatgacatattttattagttctcaatgataattccattagatatgatgtaggtaacaaacttacacatgtaatttgattataaataaattaaataatttgtaatcattaaattccaaaataaattaaacaaattatggcaactaaacatcccaaaaaattataatttttgtcatttcttaaacaattttctcatactatccaatgagattagggaaaagatgaaataacaccaaattctggtatttttaagtgtgtttgaaaagatagagagagaaaaaataatgaattaggcatatagaaaattgtctaaggggttaggggtctaataaagttaccacggaagacaaataaatatatgttttattttttcacgggccaaattaattcaaaaaaaattatgagaaaaaaattaatacttatcaaattttacatgatccaaagatattttacctaattaaaaatttggtcttatacttggatactttccattttcatccttaccttaaaaaaactcacattttaacccctgcgtgcaagcgtttaccaattacttcacagacattattatgcatgggtcaaaatgtaaactgactttatgtagggagaaaaaaggatcaatataatttgaccttatattttcttacattgaatcttttcctattgttaaaaacttgtagctttattcgaattggtcaaatttgataaatgtaacatgaagtgagaggcagcatgtggcttagtccattattagaacaaactagaacgtttctcccatcttgtagaccatgataatagcttattaatgttgttcttagtatagtaacatcaattttggaggagcctgtctgtaggttcatcgtgctattctgcataatggggaaaaagtagtcatcaaagttcaaaggcctggtctgaagaagcttttcgacattgatttgagtaagttgtggttactttgtttgttccattgacaaaacctagggattttgattaagaggatgttgccaacagccaattatcaatgaatccaaaagcctagactgttaggtacaaatttgccctttggtaccaaaacttatttatgtataacagcatagagtttaaggattactattttagtgaattcttttgtttagggtttaaggattactattttattgtttgtttgtaactattacaagtttgcttgtttgttatgtccagaaaacttaaagttgattgcagagtattttcagagaagtgaagcttttggtggtccacttagagattggattggaatatatgaagaatgtaaaacgtaagtaataagcattgaagtgcattgttatcgatatttcatgaagtaaagcatatgctaaattatgctcattgctttttcaccttttcttcattactttattttccaatgccttaatttttattgtgttgctcatgctattttgcagtattttgtatcaagaaattgattatataaatgaaggaaaaaatgctgacaggttccgccgagattttagaaacataaagtgggttcggatacctgtatgtttccttaggcaacacaaacatccgattataaattgtataaatttttaatgtctagtaaaaatattgaattttgaccacatcttcatttctttcgttgtagctggtatattgggattatactgctttaaaggtgttgaccatggagtatgtaccaggttttcatcttaactaatgaatgtgccttgtttctccttttaattatctatgacactatggtattatgagagataatatattgtatttatgggagctaataattctttctttaaagttatatattttatatgacattatgctagagaacgtatttttttaactgctcctatctctgattttattccttggacaggcatcaaaatagaccaggtggatacattaacttcgcgtggttatgatcgattgcgtatctcatcacgtgctactgaggcatacctaattcaggtggaccaccttggttctctgctaattacgatctaacagtaatatctgatgttgaatatggttttcattttggttactcagaataagtaaaatgtctcaacctatattaaaaccaaaaacgaagaggaatgaattgtcacttgaagataggtgttggtatcactcttgtagccaaaaaggttgagttaataaattatcattactttttgtcttacagatattgaaaacgggtttcttccatgccgatcctcatcctggaaatcttgctattgatgtggacgaagcaattatttattatgactttggcatgatgggagagatcaaatcttttacccgggagagactgcttgaacttttctatgctatgtatgaaaaggatgccaaaaaggtctggatttgtactacttttggattatttaaattcataacattgtcttttactaataagaaatcaatatctgatatcatgatacgctattttgttaagtgtttaatcaacatacattttttaatttcatgataactttttagtttgccacaattaactcaaacaagcacgatgacataaaatggcttttgcttcaagtacgattactattgtaaatttcaatccagctaaccagttattatcgtcagcaaaaaagaatttgacgttgctcataacttgaattgatcaacttcagtgtccctctttcacactattttaaacatacaaccatacaataaacaacggtgcaggttatacaacgccttatagagctcggagccctccaacctactggggacttgtcatcagtaagaatgtcaactacttgcttttcaaatattttgatttgtgtcttgacacttgattgacctcataaatgataaatttattttccaggtgaggagatctgtgcagtttttcctggaccatttgctaagccaggcaccagatcaggagcagaccctttctgcaattggggaggtttgttaacattgttacattggatcaatgaattcatagctgcttttcaattttttcataatattttgggtgtttgtttcaatggaactaaaggataagctgaaggtggagaattattgttttctattggttattccaaactatctggagaatctagtccagactttattattgactattgagggctttctgtggcaggatttatttgcaatagcacaagaccaaccattccgttttccatccacctttgcctttgttctcagggcgttttcaacacttgaaggtttgcatcttctcaattctcttactgtccctctctatctttctctctttagtggtcattcttgcaaaaaaaaaaaaaaaaaattaaacatgccctaatgtttactattaatttcacattagtatatgcattataagatggtaaccaccccttcctttcttgggaaaaatttaactgatttaagacacagttaggtaaacaaccaaattaactactcatccgataaattcttatgaacttatttataagcttaaatgtgaagttgatcaaaatatgtatcactttgaaatttattgaaataagttaaaaagagcaaaaggatatatatgttagttctttgtatgacttcatcatctatttgtatttctttttttctgacaggcataggttacacactcaatccaaatttctcctttgctaagattgctgcaccctactcacaggttcaaagttcagattgtccatgaacaaatattgttcccatactgcattaaaatgcatgctcatacacatacactttaccacgttacaggagcttttagagataaagcaaaagcagcgcactgcaccccagcttgtggaggagataagaaagcaagcagatgatgtaccacaccttttacctttgttctggataatgtttccttaaattagaaaaatctcatttgatgtgaagcatttatctatagcatgtgcaactaatgtgcatccacttgaattgatatttgataacgcttgctcgtgtaatacctttaggctacaacctataccatgtcaatgccatacagagttcaaagaatagaagagtttacaaagcaacttgaggcaggggatctaaaacttcgggtccgagtgcttgaggtcagtttttttttttttttttctttctttattcttatagttgaccccattttttattttaattcttaacaaaaaaattgtaaattttagtctctctacaattttttgtagtagtttattatcgccaaaaagtttctataacagttgtatatcgtcccaaaaacttctctagactctagtgttttcaatagaaatttaactttttatgattaaaacttacaatttgtttcgtataaggactataactcaaaatgaagttcattataaagaccaagtgaatagttgaatctttatttttcttcacatggtgtatgctatgcctatgtgtgaccaagtatttctaagcattttcctaatgggaacaactttctaattaggaggtcgttattctggaacttttgttttgtaaatttgaaattatttaacttgatttgctagtctgaaagagctgctcggaaagcaacggctttacaaatggcaactatgtataccgtattaggaggaactctgctaaatcttggtatcattatgagcagccaaggcaacataactattgcgaatggatctttcattggtgcaggtgactatatattataaagctttttctcaagttattgtccaatcatgttccaatttattcttaaggctgatagatatagcatttcaatgtgcaggtatttttatgactctatttgtcagatccatgcaaagggtaaaaatgcttgataagtttgagaaaatgatataaatggttaccaacaaattcgattctttcaaacttacgtaaagttatcctcatcttcattttattacttgtaatttgtaaatgttcaattttttaaattacacaggcatagcaaattccacgaattttacagaaacatgattgaatgatgacactacaaggcattttatgacttcaagacaaagaaaaaatcatagttttctaagtgagaaagcaaactgttggcccgtgagcctttccttattcaatggctaattttagacagagaacaccccgtgattaagatcatagagtggtaaagcttgtcttggaccgtaatatatctacgactaaacgaactctatctctcgtagcttgcaattaaataggttaaccccattggcggagccagtaaaaaaatttagctcatgccaaattttaagtagtgtcaaattttatttttaaccctaaataattatataagtatatataattattaaaaaaaaattcttcaccactcaattattacaaattttattttttaggtaatgtcgtgatcatggttgatttgcatgcggctccaccactggttaaccctcagaccaagaataaaaaattaagtattaaataaaaccaaaaataacctaaacgtgcatccaccaaaaaaaaaactaaacatgttaaatatatcatttttattttcattaactaatcatgaatcaatgggtttattagttaattattaatgactgatgtatgatgtgtcaattacttatttgacctaatcaactcttcttcctatttgcttcttgatttctcattaagacagtgacatgtggttgcaagataatattaaatggccgatgaatcattatttattgacttaagcaactcctattcatgtttgtttcattatttctcgttaagaaactgatatgtggatgcaaaaataacattaattgactgatgtatcaattatttattgacttaagcaacttctattactgtttgcttctttatttctcattatgaaagttacacgtagtcgcaaaataacattcttttttccatttgttaaaatttatcactgaacttttgttattttccattaaaatattatttttatataaaagaccacaaatattatttatgaaagacaattttaaaatttactttaagatatatttaaattttatgtaagtaaacgagagtataaacaattggtttcataattgtcttcagaactgcaagtggattttgagtattaattcatactctaagttaatataaggctaaattaaaagtaattaaaatctagtatttcagattttatatttgctgaatgatctttacattatcaatagatatttttgaagaataaaacatatcccgtcttaaagtctgattcgcctttatctgtaataatttaagaataaataatatatatatcaaagatttttatattattatttaattataaactgttatgtatgatgaatttattattttttataataattatcgaaataattatataaaaatatttttactagttgagaatataaaaactttacgctcattaacaataattaaacttataatttaatttttgtacaggctcatttgtaaaggtggttaggaaggtgagggaaataacgtgcattggctgtgggtcctgagccgttggttcgtaggctcgaggattcaatatggtaggtacacttttaatggtagttattttttttgttttttctttagttattaaatgcagtagtactatttaaatcatgttgtatatgaaataaatgttgaaagaaaatatttaatttatgtgcactcacaatttttaagaatatttatctcttatttttagggtgaatattttgtattaatgtatcatggtcagaaaaaaaaatccttaaataacttttgattttataaaattgggtgctttaacaatattatgctattttggacaagaacgatcaaaaccaaaatgggtttaaaatcataactataagaatcaaaataaaatattttaaactataaaaattaaaaggtagaattgttgcaactataaggaccaaaaatatatatattataatttggaaaagttggaaattttcaagctttcatgacttagatattttcaataaaaaaaaacaaggttttcgtgatataaagtatattcaacatggttattaaaaaatattttcttgagaaaagtatttaattttaataagataataattaaattattttatagaaattaaatttaagaataattaattttttgtagttttttaattcttatgtaaaattgaattttagtattaatagttctatctaaataatttatatggataatatgtaaataattatgtaatttatcacccaaaattgaaaaagacaataatatctgtttatcgcttaataatataattctagtattagctcatttgtaaaggtgggtgtggccgtgtgggtcagtgaagcaacgtgcaatggctgtgggtcctgagacgttggttcctaggcttgtggatccaatacggtaccgtttaataataggaaaatatatatttttagtcgtcatattttcaatcaaaggtattaaaggttcatatattttatattgattaatttaattctcagttttaaaaatatataaatttagttgccactatctaaaacttcgccatattttttaataattaaaagactaaacttacatttttttaaaaaatttaaagataaaattgatgaatatcaaaatatagaccttgaccacatttaacgaaaagtatagaagttaaaaatattttttttctaataataatttcagttcactttatattttttattaaattaaaaatatatataaatttttgtgagtttcactatttatttattgagtttatttttaatttgcagttttaaataaagtttaatcaatatgacatttgtttccttttaattattaattttttagaaaaaaaatttactatctggtatttatttttcacttttaaatttcaagataacattgattattagtttgtcaactattccctcacttcttacctaatttatacattttatatgtatttattgtgaagcaaacctaaaaaatggtataacaggaaaattcaaaaatattaaagtaaagacaatcttaaaaagtttacaaactaagggacaacaaaaattaagatattaatatcagtttaacactttttgtgtaaaactaaagatatgatccacaataaaaatgaaattgagaaaatatcaattcaacaccttatttttttattcatttttccttaataatattgtttttcatttttctctcttatatttaaagggtcttaaaggagatgggtcagtgtccatgctgattcctcttgggttcattcctaacttgaacaatagtggcatctcttatagcgtatttggtaggaaggaaataaatagatgagagataaaaatgatgaaattagggaaaagagaaatagagtaaattgaaatatataagaaataaaatgaaatgtgagtgtcttatttaagagaaataaaataaataaatacaaaaaatccattttagtattttcaatccattattttcatgacaattgattgtcatacattttaggtagtttaatgttggtttcatatgaattttacacttttttttttattttctctctaatttccatcctattaaacaactcacatttctcatttattctttattatccttcccttttttctattttccttctatttcatagctaccaaacaaattggtaagccaagactttgttcttgctagaacatcaactaattatttaaaaataagctataagctaagagtttataaattaattgatttatttggtctaagtaacttgtataaactaataagaaaagcctataattttccccaaaaccttatcaaacacactaaaaagaacaatgcgggtaggtaaattgctttacatcgtgtatttcaggtctctttcatagctatgcttgataagcaattgatttgggtaatggttatttgttacttgacggatcattttgaattacctcgttaatactgtctataaacaaattatacaggggttatgattatagatgtcaaataagtcatctacctcttatgctcgatcaagctaacactatccaccgatacaaatcaaacaccgaaagttaaatttcaaaacttccaacgaatcttatgtgacttaattttttattcattccaattacaattttgttattttaggtattgtattcattcaattctctccgtcaaattctattagaggacctggttggtcttgatctttattttgtaattatgtagttgagattatgggactgtttatctatctcatccttttgatatatatttaacatcttcatatcataatacttgatgttgaagaattgtgtatcatttaattcttattgagttgacgtgttcaagacaactcggatgtcgaacaatcttattcaaatacgacattaccatataactcatattagatctagaaaacaaacatattacatttaacactttatgctcttaggctaggtttcctttcttcgatacacaatcttccggcagtcatatataattttaacttgacattggtaagccacatgatacttcaatccacgcagacaagaactaattttaggcctacaatttatttatatatatatataaaaagtgattaaattatatcgatataattttgacaattattatacaattctataactttcaactaaataatattttcttaaaactcatatttggttgaaaatttctttcacataaatcatatatacaaaatttcatattaatccaaaaatttattaccttattcatatagattaaagtcaacataatataaacatttcaaaatatactaaaaaatgaataatttgattatcttcttcttgttattcaatttcgacaaaatttgacataaataatctcaatactatatagatataatttaacgtttgaataaataaaaatcacattttatattaaattataaaaatagtataataattgttaaagttacatcaatataatttgatatctcatttctatatatatatatatatatattaaaagcgggctacagtttatatgtatgcactttgtttagttgattggtaggtggctcaaggactgcaagtgtgtctttatatgaaaaataaaaaacaattagtgtgcatcgcatgcaccccattccaaatttaattaagttatcatctctgttcaactaccccacaccaaaccactttgccgttgctccccacagtgctctgtaccaaaaacgtgaccaattcaccaatcactgttgtatgtaaaattaccttaaacttattatcaatttatttttaagaagacactattgtaatcgacttttttcatgtgcatgaagatattttttaaccggaaatttaaaaatatttattttataaaaaaatcaaaatgaattatatctatcttggcaaagcttttctacacaccctaatcagcatgctatctaacaatttgttggtttttttggtaacatcataacgtaatcgatccacgttaaatttacacagtcgcctaagccaaaaaatgtataaaagagaagaagaaaggaaaagaaacaaattgaagtaaataactatgaaaaattagtgaaaagggtttttatattgtttatctaatcataaattatcatatataataaattaattaacttttatgataattattttgaaagtcattgttttttttactgatgatagtaatgcaattttatacattagtaataaatgcatgcataaaaattataatttaatttatatatatttagagtttaaatttttttacacaatcaataaaaaaaacatgatattatggtaaataaaataattatagaagtcaataaatttcttatacatattgatttattattagataataacattataaaaattagggatatttgcatccaatctaataaaaaaaagcttgcaaactgatctaaaaagaagaaaaaatttgataaaaaaaatatattttaaacctatgattaggttcgatttaaattagtatcttaaaaagatttaatccaatccaataaaatatgatttgaattagattggatggttcaaatcttactactacatatattattatttttaaaacaaacataaaatgtatgtcaatcaattgattaatcatcttacaacataacggtgaaacactaaaaaaatcatattaaaatatataaaaatcatatatggaacatataataagatatgtatattaaagagtatcgtttttgcttagatcgatttagttttgctaacatcaattataaaccaatccaaatcatcgattaagaaaaaacatgatccaactcaatttgcagaagatgacttttatgtcaaaagtgaatctaaatcgatttaatcattcagcatcgagcagaaaaaaaaaaaaaaagttgggaaaataagagtaattgtaactcgtggctcctcccacctgagctgaccatatataagcactcatatcagtcggacacttgttcacttcttctctctctcgtaagcttctttgctcaacactttatcagatccgcgtttcgcttagcaccacatcaatatcatatttgcttctctcttcctcacttttctattcaccgctccttccatcttatttgcttctttatggatacattaagacaccattccaaattttattattttcttacaatctcgcgctgcttcttttctttttaaatttctgaatcatttcatatcaagaggtcaatttctgatgtttcacataatccatcgtacatggaattagttctcaatgattttgcatgttagctcgttaattttacctaaatgtgtccgtatttaatgttttggattacagattccattttcatctatcaatggctccagtagctgcagcatcttcagattcaatcaagccaagaggtctttcatcaaacattttggcttatagatatagagtgtttataaaccctttctttggttcatttaacaccttctaaagttttattctgtataaccctttatttggttagttgacttcatatgttttgatttctatagatgtttgcatcgttggtgttgcacgtacaccaatgggtggatttcttggtactctgtcatctctatctgccaccaagctaggctcgatagctattgaaggtaactatggaagcctatgtcagtgcttattacattccatttgaaacttatttgtgtttacatatttttcattcatctgtagctgctcttaaaagggccaatgttgatccatcccttgtggaagaagtattttttggaaatgttcttagtgctaatttggggcaagctcctgcaagacaagctgctcttggagcaggaatatccaattcagttatctgcactaccgttaacaaagtttgtgcatcaggaatgaaaggtgtgtttataataaaaacaattctatttgtttctttgtatttttgtttaaaaatacagaaaaaggatattaaccttgttccggttattgcagctgcaatgcttgctgcacagagtattcaattaggcacaaatgatgttgttgtggctggtggtatggaaagcatgtctaatgtacccaagtacctggctgaagcaaggtcaatattgcctttaattcgacactctccttaagattagttcttgtgttgaaataaactgattcaatactaaaagttcaggaaaggatcacgccttggacatgattcacttgttgatgggatgttgaaagatggtttgtgggatgtctataaggatgttggcatgggagtgtgtgctgagctttgtgcagataaccatgcattaacaagagacgaccaggtattttaggattaatttctgttcagaaaggtttcggtaggaccattgtaatcaattttttgttgatgtctctgttttaccctcaggataactatgcaattcagagttttgaacgtggaattgctgcccaagaaagtggtgccttttcatgggaaattgctccagttgaagtctctggcggaaggggaagaccatcaacagttgttgataaggatgaaggcctaggaaaggtacccatataaataacttgaaccatggtaatacttgttcttgtataaatatggtgagcctacgaaaacacatgtttacccaataattcacgagactttaaatttgttagaagactataaggtgataattaatcaagagttgggattggaatttatgatttttttctcttcacattaacaacatttatatgtatgttacttctagctgcaattattgttactatagtcattaattttgtctatactttcagttgaatacaaataaatatattgttaaatttttccttttcctatgccagtttgatgctgccaagttacgcaaacttcggccaagtttcaaggagaccggaggctctgttacggctggcaatgcttccagcataaggttaatatgttatcgaaatttgttaaaatttttcctacataatgatttgtatttggatgcccttgtcaattatttattgttataaaatactatatatatatatatatatatatatatatatatagggagtcaaatgacttttttaattggtcgtgtgaccttaaaaaacttttaatattgacccttcgtgtatggttgtatggtccaaatttgttcatcttattcttatatgaaatggaattttcaatatatacatctccaatatgtgtgtcttaaacgctcaaatgctattaatatttttgtaatttttagtttgacattagtgattagccctggtttttaataaaatgaaaattctcttgctaacagtgatggtgctgctgcactagttttggtgagtggagagaaggcactgaagcttgggcttcaagttattgcaaaaatcactggatatgctgatgctgctcaggtatgtaaaatatattttaaatatgaactacatcttcagactataaaaaataagaaatagaaaaaccattttggcattcacattatttctagtgtttgatatgttataatttcatactcatatgaggttgagctgtgcaggaaccagagttatttacaacggctccatcccttgccattcccaaagctattgccaaggcggggttggagacttcacaaattgatttttatgaaattaatgaagcctttgcggtaggatttcatgtcaaggtttcaatggtagtaatttttcaactcatgatgcggtgaattttaattcttcatattgctgtctgtaggttgtggctcttgcaaatcagaaacttcttggacttaactcggttagtttttccccttgtcactgtgcgaaagttgtaatccattagtgcatgtataataaactatttccaattgactgtcttgaagagtgcatgctgttgtaagtccagaacccctctttgcacagtgcagaacatgttaaaatttgtctataatccataatttaacttcattatgaccattaatggatgcacccctccatttatttcttttactcaagtaactattattttgcaggaaaaagtaaacgtacatggtggagctgttgcactgggtcatcctcttggttgcagtggtgctcgcattctggtgacacttttgggggtatgtgctcagttcataactttgattttttataatatatagtagcatgcatgttgacagattgccttgtgtttgtagaaaaaagtctatcataatgctcatctcttaaattctttgtttaattatttaaattcgttatgttcaactattcaaaaagataaagataatgtaataattttattattttgtccacttttttttaataaattacattgagagtagtttgttgtgagagtgaaatgaacaaatcttgatcatttgatcttatatgaatggtattacaacacaaaataataagatttttaaagtgatcatctgatattttaagtaacttataattctgactataagttgttgttgggataaggctttgttgttgttgtttatgattttgactaactatgtatggatctttccccaatattgaatgtgttctttttcgattcagttaatctaaaagtcatcacctgcaggtactgaagcagaagaatgggaagtacggagttggtggcatttgcaatggaggaggtggtgcatctgcccttgttgttgagcttctgtaagacctatttcatgttccgtagatgtacttttaagagccagcgtttgctgcaaagctcaaaagatcttgcctccctctttagcaagcgaacatgcaagtttcaaatttattacaaggacaagaccgaacgagagagaaatttagctacatagttgttaggtttaagtcgcatcttgtgaaagtgaaattttcttagcatcaaagtagaacatgaaacaatattatccaaattttagttttcaccgaaattttattggggtactttggtttggaatgaatcattataaaacctgttattccaagcacaagattacagattcccgtggtttgcaaaatgtgttccagaactgaaattgccaaaaaagtggaaataatgaagttgtagttggtcttgcgtctgctaatttagatctaacattttattctgaatattctcgcacgccaagcacgtcaaagtattttctctttcttagggggttggttaaaaagattcacaacacgcagtaggattgactaagcattccaagatattttttttgttcctaagattaatatgagaaatttacagtgcaccgtctacattaagtttttgggttattattgttattgaagtaaaatatttatcaatgataaatatctattaaaaaatttgactaattatttctattagagtttttttaattatatttttttcatatataaaatttaaatttgagatcaagtttaattttattcgaattaataagatcttgataattaatgctagctttagatagaatctattctacttattcttattgcctttatttttcttccagttacttatataaaagagtaatgttagcgcatactttctactccatttggtaaaagatttttagtttggaagattagtggtcaagtgaacgacgaatatttcttgaacttttgataactaacatgaaggaggaataaaagatggttatccaaccaaatacgtaaacatataaaatcgtaaaattaaaactataataatataaaaagaatcataaatggtaaacttaatatatacctgcttaatttctgtacttttatcacactagtttttgtgtaaagaatgaatatttaggtgagagattttaaatagaaaatttaatttgtaagagaatttaaaattttaaatattaggccgattgttatagtttcttttatgaaatattttttttccgttttgcatgattttgtttcaatttttcaaaataactggaaactaaaaaaaatatgactaaaatcagaagttagtttgaaaagtttttcataaaatcagttatttcttaaaaaaaatattttttagaatggtaaacaaaagcaaattaccttatactgtttttttaaactattttacatgagaataagttttatttaaaagttgtatttgttttatggtatcgaaaaagattatcgagaaagtgactgagaacatcgtattttcatgtttgatataagttctataaaaaaaaattattgatttatgcaatatgaattatttatacttgtcattttattttcatggtgaaatagaaattatttttttggaaatggaaaggtccatcttacattcccataaaaaatggagctattttctactatgtcctcacttcattctttcacttttatagttttatttttaattttttattgaataaatttttatggaaattatatttgtacgcataatactagctgacctatttatgaaatttcttttatgaaccctagcctagcttgcctcagcttcttacgttttcgcgctctctctctctctctctctctctctctctctctctgttgtgaatcgagattcatcacttaaactcggcccattgtacgtttctctttctcatgttcgtttgctttcgattttattttgcttcctaacctcattcttttccttctttcctcagctccgctttcttcaaatcgtaaagttttttgggattgaagaccgaatcgttagtgagttttagttttaatgtttgtctgttacaacaaaatctttgttctgttctatagttttcaaccatcttgctgctgattttgtgatgttcaccctttctaagctctctcttgcagtgttactacctctgcatgtacttaaaaacttgttaggatttcaagcatttaaggttgaaaagattgtgtctatgagaatggagttgaatgctttccccaagtcaatttcaagtcagttggggattttagcctctattttaggttgtaggatatattggtatactgacctgaactttagtaaatgaccttttttgaaaacctattcagttcacattgtttctattggcctaaatttcacataatgggaaaaatttgggacttcattggtggaatgtcgtgttcaagtgagaagcatgggacatacaaagaaaaagtgctaggtgaaatggtgaatcacccaagcaataaattactgctatgactcatttgcttctcaatcattttgttcgaagtgatatttttggagtttattaagaaattctacatgtttagttgttcgtgttctcttatttggtttaatctattagaaaataatgaaaatctacatggtgatgctcttcatcttatccaaattatgtcaacccttcagcactattccaattctaatagcctatcatcttactgacgttgtcttatagtccaattgtgtcatggtacaacttcaatatcctcaacacatcccatctccctaagcaacaattatttttgtacaaaataatcaagaacctaagataatgagagaagactatgatatatagaaatatcgaatagtataaaaattcatttaaagaatttgatattatacacacacattattgtttactaacctaatacctattaagttacacaaaaacctctcatcaatcttcaatcgtatattttagttctgaatattcataaaatttccgtgatatgaattcatcattttatttttttaggggattttcagggtacaatggcttccaacatctcgcccactgcctttgataaagaacaggtaggcattcttttctcttcctccaactttggtaaaactgatctggtggttgatgtggtgaatttgataccccaatgtgatttcaagtttaaatttgcttttctcggtgttatttgattatttagttgtggatgtgtttcaataattcatgtggtcatggagcagatatttggaatggctgaaaaggagatggaatatagggtcgaattattcaacaagtaggtttccctgctcttgcttgccttgatattgtttgctgttgtaaacaagtatactgtacaatctgactgcatatttttatgagatttgttggtgccataataattcattttgctaaccttctgttgtttctaccattcaggatgacccagacctgtttcaagaagtgtgttgacaataggtagggaaactcttatgattgcataatctgcctgagaaagtgtcatgtttgatgcccttcaaatgtcatccagtccagtcaatttggaaattagtttcttatttctcagagttatctgctgttgcattattttgataatggctcaatgtgaatgttatgataatatctgtttatcactttttcttctcaggtacaaggagtctgagctaaatatgggtgaaaatagttgcattgaccgctgtgtttcaaaatactggcatgtaagatgttgcttaagtttactttggatctatcactggcacttattcgagttgctattagttatccttatttttctctcatcaaactctttattatgctttaagatagtttctcacatagatgttttaggatgaaatcttagttgggttttagtacttggttaaatgtgtgctcccttcgaaaattcctggttagactttaagtggtgtcttgataatttcatgaaagccaaggcaaactaagtatatgtggattacagaagtcctgacttcaatatggtttttgcttttgaaatattgggaaactgcaaatggtgattgtcttattgtctaagcagattttttttatattttttttgctaggtgactaatctagttggtcagctgcttgggtctgggaggcctccaatgtaattcaagtgtattgtattttcttttgcggttagcaacctgggagctatgtctacgatattattagttgttgcttccttggattcctttcttcccaaggaagcgtaaattttaatactttgcagagtctttattttgtggtcaatctgctttgtttagaaagggattgatgagctttttttaggtcttaacccctcagtttatcaggggaaaaagatcctaactaatttggagtttggctgaaagttcaataaaatttgacaaaaaattatttgtcaaggattgatgagcttttgaggtaaccattggtggacaataaaattaattttagataaataaggtcattctttgtttctaatttatgactttttagttctgccgtactttaccatagtgcttttctatcaaatttatttaaactttatcctcttgcaactgcattgttcttttcccccgttcgacgttatgcagttagaaacttaagaattatttcttcctttccgttttcaaacagtatacttacttacaattattcctcgcccactttcttgattatcaccaaatatataccacaaattcaaatcaatatattaatacctcaattgtttttttttaaaaaaaaaaaaaaacttgttgctatggttctgctctgacatcaagtgtcttaagacatgttgaagagtattatattaaaatgtgatagaagttattttttactctgtgtactaaacaaatagcaattacgggagtgacgagaatagagagggtattgcaacataactttcataaaataaatcatcgctcaattttgtaaattaaaacacaagttcgttaatatcgtgttcaaccatacaatcattctctctttcaaatgggatcaaacttcgataaattatgacattcataaaagtatgtattgggattaatacttttagagaaaactcggtttgatttttaaaagttacatatgccatcattgcatttgaatctaaatgcattattttcatagttataaaagattgataaaaataaaaatctaatttacttagatttaattccttctcaaaaaaatagttacagattttatcactgagacatggagacgttccagaaccttttgctacttcctgtctatgaacttctacatttctcagagatagatctaataaatgggggttgacttaggtcacataaattaggagatcaaagtgataattcttaaacttagaaaattaaaatgagatgccaaagttctattttagtctttatataaaatatgttaaagtgttaaacaatagcattacaaatactattttctatgaaaaattattgtagttaattaattaataatagtaaaaacgttgatgagagtggcagtggcagtggcagctaagtcgataccgtgcacatgcaatatgcatgagaaaatggaaaaggaaaatgtaaaaaaacaagaaataaaatagtagattaaaaggaataattccaagctagccagaggcaaaagtgaagtgaggtaataaagacagctaatgtgggtggggacagaaaagtggccgttagaaacttgaacgttaagccgatgacagagaatccaatactgatataaatactcccatttctgagtatctttcattcactcaaaaactagaagatggggatggttgtggtgatttctcttcctttcataatcttctgcttacttcttggttttggatgttacttctttggaagagccagaggaaggagagaggttcaaaccaacccacaagtttatgtgatgccaactccacccccagctgcttcaccttcaccaccccggccccactccaagccagacaatactcataatgtttgatttcaaatacatattgggtttcttttgttgtaattatttggtccttttagtaattcactccaataatattaagacctctcccccattttattcatttccataacctctatttattttttgtcttttatgtactatcccttgttttttggttgaaagttaaatcaacttttatacatttttattgtctgaattcaattttgctcaagttgtgtttatagagccgagcattccatagtgtcactggcctttgcttagtttcacaaaataccatcaatcagtcattagtctttacgatgttgggaattttaaaaccaaacaaattctcggttaagttctttcttttttttacaggaaaaaaaattagatgttatatttacgtattttttatattacttttttataaaaataaagtttactttgttgttattgttattttcttgaaaaatatttagaaaataagaaattaaccttttgttttgtgaacatgtaaaatcaacgttgaaaacatattctccttataattaatagttattaaaaataattattaattatattccctttatttaactttaataaggaacaataaatctaaattaagattttgttaacataaatctttaaaattaatttcaaacaactaagactaaaaagtttaatattgtacttttatatgagaaaatagttttatcataatatttgattgattgttataaaaattaaactctttttttagacaaatttaaataaataattttttttaataaatattttgaaatttgggactgttttgaaattatttcaaatttggagcaatcaaacaagttcaatttggacgtgttccagtctgtcgctaacattttttacggaatattgagattttaattccgttgctatttccgtcactaattcggtctctaacacttctaaaaaatagtggttttttaaaatgtgttgcgactgaatttgcgacggattttaaaaagcctcgaaaagtgttagcgatcgacttagcgacggactgaaaaacgcccaaattgaacatatttgactgccccaaatttctaaatagtttcaaaatagccccaaatttcgaaatatttgttaaaaaagcatttttttaaataatttgcccttttttatatatgtgtgttatacaataaataattttatttatttaatattttgttcacttataataaaatcagcagtaaagaaagcatgaaaaaagagaagtgtatgtctcataaatttgatagtcattgacattggcctgctcctatgtgtttgtctgtgtttctcgatcttcctccttggccttgccctcgagaactaaaaatcaaggaaaaggagaaggatcaattaacaaacatcattacataatataatataaatatatattagaagaatctaacagttaaggagccaaagccacatcattcaattcctcgatctaagatcttgcagctagaagttaggagctagtgatgaaccatggcggtacgtacgtacgcagggcggatgcaggtgtaagattcccccccttaaattttcaagaatagataattttttgataacaataaaataaaataaaataaaaaatagtttagacgtttgcacgaaaggagaaattgaaaagcatagaaaaagaataataaaaaagatgaaaaataagagaggagtgagtgtgagtatgtatgtttgtaatttttatgaatgcagtgatcacactcttgttaattttaagcaccagtcacacgctaattttgtcaattttttctctcttaaactgaacctttttcacacttttattataattatttgtttctttattttttattatgtgcccccttacttttttttccggatccgcccctgtacccacgtacgcatgcaattaattaatatttgttgatggatggctctgtcaggagaggggtagaggtagagcattacctaagtttggggactcgggagttctcggtaatcttcaacaatgccaggaatgagagaaggagtggtgctaataacatgtaacttaattaccttcttcttgcttcatgctcaatcccggcccttacgttacgttttttcaaatccatcattgcagaaaaaatggttttgctgcatatgtggtgtatgtacttgggctttagttggatcagtagtatttattgcatcatatactggtatacttctctctctattctttatagtagagtttgatatttgtgtataaactatatacttatttattcgatcgacctgcgtactattttatatatttcttattggattaactgttttatactaattcatctctctcgaccctcggtcgagtcacacggaaaaaaacaaaatcataattacagaaagttgattgcaatgttactaaagagatgccagtcactctcctgggccaaagaatttattcttaattttaaggatttgatattcaagtgtgtaaactgtaaagtgagaaaatggatatgtatctatccctaattgaaaatttgatatttaatttacataataatttgattcaaatttaagggttaatgcacgtacccttacatacctttgtcgaggtaaattattcctttaccggtgcattgtacttcgtgaatttttcctgttaccatctatacctaagcttagttatgagccaatccgcaatcctattttttatcttgtttatttttaagctataataagttcttaaatgctgatagaggtctatttttttatcaacagcagcaattattttaaattactgaaatgggtataaattatataaatgaataagtcgtgttgattttagtaaattaaattttacaaaatatacaaagtcgtgtttaaaacatgactttttttgttcaaagttacgttttataacacgatttacctttttttttaaaagaaaagtacacatttcggtattttttataataaaaaaaaaatacgtgtttggtaaagaagccgctgatagagttagagattcctgttaaatatggcacgactcgagaatgtaggttaccactgcaacttacattcaatatctgagagagatcttgctcacaaaatacatatgaatttctcaagagccgtaacaacttaagcagctgaaatagagtgaagggaaggtggattggatacttaccggataagaaaagaaggagaaaaacaaatctaatattctaacaattaacatttaccgattaaaaaaactggcagaagtaaagtaaacgaaaaaaagatgaataggacatggtgggagcgtagaaatggcctgtcattttttagtttaccggaaaaagaaatcaactataaacaacattaaataacatatttccacatgtattatgagtaggattgaactagttatataaatatccatgtgatgacaacggaaaaaagtttaaaataacattctcatttgtactgttacagattctcagaacatttcgaagctctaaactctcgaggtacccaactttcgttcaaacaatcgctgcagaaggtagacttgcagcgcactagccccaatcagtgctgctgattcaaaaattgccttgtgtactgctcttttgctcattgcatcgttcactgcattccagacataagtgaacatgatattgcatccgcagtcaagaagtgttaatagaaggaagaaaccagtttgtagcttttatcaactacgatgcttagtgtatttgttcagtaaatggacatttcaccataatcaacagtgaacagtgaacattgccaaagagatagggagcaatgttctcaacagggaggtctcttttggtatggtatctgaataaattaggatgatcacatgttgggacatttgttcatattaaatggtatcaagaatagaaaacaagagggcatacataaacttgggtttttatctttaacacgagtaatatgtataattgataggtataaaagattttatgcacagaaaaatgtaaattgtgcgataaacagcaaagtaaaccttaaataatacctattgcttggcggtcagtctgagcctctaaccaatgttgttcaaactggatgttgtatagagcttcctccaacttcccaatctgctccagcaaaggggtgaaatgctctgcagacagtcacaaaaagtttcaatgaaagttctcttattttttagacttccatgtaacttaaaagagcagtgttttacattttttttaaaaaaaaaaaacagcaaatacaagtggacctcatagaaggggcattaccatcttttgcatgttgctcaaagtaagagaagtgaccaacatgtacatcaaaatcaacagtttcatgataaggagacttgttggtgaagcagaatttatggaccccagatttgtgagccacaaaatcgaatttctcagttgccttgtcccgaaaatcttgtatttgctcgccagaaggtccctttacctgaaattcttacattgtggtgtaatgagattccaacatatgattgggtaggtattaaggaaaaagaaagaaaaaaagcatttcaaagaaagggtattcctaacaattgtgtaagtaccatttatatgtaattgtaaatgtaaaaggtgatacatgtaaattgctacatataatgcacaacatctctatgaccactcatccttctctaaattaaagaactactgttttgaacaatgaagttatctcctaaaccattgataaaactttttgcttcattaggtgtttgacaagcattcgtttttcctataaaaactgtgaactgttttgcacagtgtagttatctcctaaccgtggcttcattaggtgtttgacaaacatactttttgcttcatggtcaatgaattaaaatttccagaatggagttcaaggctttaagcttaacaacggatcccaagatctagaaacaaataacagtttcatggttatagtgaagaatagcacagaaagcttcttcagcccagagagctacataatagctttagcttcacaatataaaagaataaactattaattttgtccctcaagtattatcctgtctattatgagagtagtctctggaataataaaaaaactatataaataattcctcaagtattgaatattcatcaatttaattagtctcaaaggtgatgcattttagtaaaattcagagaccaatttgaagggccttttaatacttgggggactaattagcatgatttcaaatacatgagaaattacttatataggttttttacattagggattacttatgagaaagggtagtatttcaaagatgaaattgagggtttgttccaatattaaaccctaaaccaatagccaacaggtaggcgtaagagaaagcaattattgttggttctctttgtattcatgtaccctatggttctattcccttccctaaacttcctgtcaataatatatatgataatattaatagcttgagtaattgtgataccccttgaaagtgataaagctgaaaataaaagcggtaacatagaatgagatggagtgaaaaagaacataccacgagatcgacaccttcgtcgccgtaatgccagggagaatcagccttaataacaacaaaagagacatgaacagtgtcaccctcgtactttacatcatgggagaaacactcgtctctgtctatcacaaatcggataccctctgccctttgcaagttccacaacgccccaattaacgcaaacaccaaagcatgcctcaatgataacctcatctgcaaaacaatcgattaaattcacacacgtctcaaaaacacggatccacaaaatcaaaagatatatagataccttggtaagtttctcttctcggaaatttgaagaaaaggatggagatgaaacaagaaaacacaacacaacacgacacacgcagttgtggtttttaatttcaacgtgtgtttggttcagactttaaaagtgttttgctggaaactcgaaactggaaaacggcgtcgttgccctaacttcggcttttctaatgtgtgggtttttgattggacggtgtaagtcatcgatccaataacaagttcacacgtaggatatgtttcaaaaacaacaaataactctcctcgtcttcgtgtgcgaagtgcaaactaacacacgtaagctgagttcagaatctcgtctcgtatagcaatttgattcagatcagatattttttaatcaaataataataataataatttttatctgtgtaaatgcggaaaaaaaatagttgaatgtagtggtgtataactttctcatattgttatccaaaattcattttttatttacgtaaaaagtaaaagaatcatgatatgttaacgattatggttaaggcacttctagttcaaaaatatagtgcatataaataaatttgtaattatttaaaatatatttacgattttatatttttaatatgataaataattatttttaagaaacacctttttataaaaagtatgcttaagaaacaataataataataaaattaaatcctaaacccaaaatattttttataaaaagtgttgaaagtaactaaaaatattttttaaggttcaaacttttaaaattatctttaatcatattttttaattttaaaagtttagattttaaaagttaataatcaaagactaatttgaaataaaaaatgacatgtaatttaattagttaaaaattaacaatatcaaaattccaaattactgggacaccatagaaattttaaaattacatgtatttagactattaatattaattatgaaaataagatttatgatattataattatagatattaattttttgaacgtatgattttaaacgaattgaacctataatgggttagaccattactgttagatacttctgttcacagtttattttgaggtaataacaagaattcgatattcttttcaagtacatgcctattaatgttttataaattataattatcattatatgattatgactgtgcataattttctttaaataaaaaattgtcgctaaatttgcataaacttcttcatcattacaattattaatttgtcattataaaaaaaaacaaggatatatagcatcatacctctgtagccaacaaataagtctcaaaaataaaatacaactagcagatgtaagaacttaagcctttttaagaaattccataacatgtgtgttgagaacacaacatgctattcggaaaccatggaatccagctcctttagccaaggccttgtactctttttctgttctctcttttccacttgggctatgacacaacatgataacatccatttgaaactcacaccttgcagctaagttagaatctggggtttctggacaaataccttcagccaaaatcacttttccagtgtcgtcaggaagggaatcataacaattcttcaacaatttcaagcattgctcgtcattccagtcatggcatacccactacatacaaaaattgtattgtcatgatattattgaaatataacattttaacttggtttggctctttccaaatataatcaatataaaaacttgaaaatggactgtttaccgaatgaacatcatattaataacataccttcataaaaatggcgtcaccttttggaacactcacaaacatgtctccaccaatatgttccacacctgcaccaaacccccatattagttctataatatcacgtacaacaaaaaatgtgataaattatttaactcatcttttaaaaatccaaccaatcattaaaatattaggtgacatgaaataccatattaacaaagtcataaaaaataaagttaggttaattttaaattaacataaaaacaccatattataaattgtgtaagataaaaaaaaatcttaataaaagtgatagcaattcatcaataaaccttataaggccttaatttgattaaacaaaacttggtgagtaaaagaattttaaaattttaaaatgaccagttcccattgataattttgagttaagagacttgccatttggtcaaattccgatttttaagggttcaaggtcgttgctttctgcacgctttgttggctttcggactaatcaatccgaaatgtaaaattacattccaaattagtaatacattttgatttacgaactgaccaattcgaaagaaaataaaacattcctgcagaaagatgcaggaagcaatagtctggatccaagtaggaaaaccaaacaacacttcaaattaacatcccaggcccagcaataaatacaattattatatacaaatgatgctactattaccaaattaattatcacaggaatgagaatgtaagaaagatccaagttagaacactcgcttagcttattttttaatttttttatagtcagtagagtcaatccaaactcgtaagatatgaactaaaaagcacctgtataagctggagcttctttgatgacgtggggtaagtcaaaattaacacactttgtggtgggatacttagaggcaaccatattaataatagctccagtcccaccgccaacatcaaccacagatccaacaccctcaaagccattatagatctcaagaattttcttcattgtgatgctagagatatcagacaatcccttattgaaaagcttgttgaatctaggatttgtgtcatggaattcaaaggcagtcattccataagcattgctgaatggatgcccaccctccttaactgaatctgtcaagtggtacctacaagaatacagtcctttaaactctatatctaagacttcactaatcactaatcactaaccactaattatatatataaaaagtttcgttgcaagtatatttgatttatgctgctgacaatctttactttatagtgacatataaaactataaatatcattacaaattctcatttttaggtgagaatcttttctttagaggtaagattatacgaaagaacatataaaaggctagtatagcaccaattaaggaaaaaatgacaaaatctgttaagataattttgacatgtaaagaaaatcacaagagatgtcacttaaaaaagtagattgcattgattttagtattgtgaaaaacaggaggagaccaagaaggacattggagcaagttatcaagaaagatttcaagttttgatttttaaacgtgttgaaagatatcatgtgatttatatagtcaatttcacttagttggataaggctttcttgttgtattacaaattaaactctcttctttatagtgaagttacctttgacatctaagttcattggctaaaattttgttggcctctttcttcaattattttggcaaaaatcgcaaaaaaaaaaaatcctaagcgttctatctatgccgttttagtcatatgggcaaaggtgattatagttattgaattattcatacttaacattttatatcaattaatgggagttaactgatacctctaactctaactttgctaatacaataaaatcaaaagggccagaagaaagagagaaaaaaattaaaaaaagtgttgaggaatagtgaaacacaataccacatgtctttaaggactttgtcctgttccatgagaaagtaagcagccacagagacaccatcttcattgttgacaaggtatttggcttttgggtgaagaccatagtgcctttcagccttaccatgaggcagttgatggagtgtgtaagtatgttgtagctagccaagaggcgcaacatgcggtccagcatagaaggtgcgtgagggttctttattgctgggatctcagcagctatatgagaaggggaaaggtaagctccaggacctgccttggctatagctccaaagctgacttgagaaccatggagacagcagtgccacccgctagttccatgccaaacaagaaggcttcttcatctgatactacctccattctgtgctaccttataatcactttcaacaggtaaacttcagaatgactcagaatctaaagtcacacattagtcttactgttatcaatgaactaacaaaattataatctcacagattctcacaactcacaaagactcacacgcagcggaaaaaatataaaccgagagagagttatctaacgcgcacacacactaggaggaagagagaaattcagcttaacttttactcactaattccttcactcactgcatatttttaaaatgttacatgggtggcctttttataggcaaagttaatacaataaaatattataaactaaatggctaagaatgaaaaatggtgcaactatggaggtgccgcaattgccgtatcttggacaattcaattcagtgacttcttcattcatctagtgaggcggttgcattttttttaggcggtgaaaatttgctttatgttgaagtataaatttgcttgatttatcttaccgacacttactaaccttaattaaattgctccttcaaatgatattttacttgaccaatatactttagtctaagaactgtgaaagcttttgccactggaactcctccttttggtttagaaacacctgaacaggagaaaacaaagttttcagaagaaaaaaaagtgaataatactatttgatatctcagacagcaatataagtttaatgattgagtaatcttagatagtttaaaagaaactgcattgagtaaatattagttctgattacaacattatgtaagtcagtccctaatataattatacatgagcagtattcagttctccactgtcaacctacaggaaacctgtgaacagaaaaaccaggtatacttttcttggtaaggaaactttggctacatgggaattggcttaaaacactatctgcgtgtgtgtgcaaccccttctcactttcagttgtaaggtaaagtaataactaaaaaggagctagtcctcatgaaaaggaatgatgcaaaaaagtttatgaagaaccctttagtcctttcgacaagcagaaattaagaaaagtttcagactaaaagccattataccctgcaactacctcataaacagtgagtagtttttataaattactatttatagcaattaactcttaactaccttgctgacccatgtaaacgcaaaattaattgacttgtgaatcagttgggtttgttatcttcatatttcctcttgaatacacttcagtaataggccccttattcctgacaaacacagatgcaatagaatacaacttgaatatggggatacaataaattctaaaatcatcatcacacaacacgtctacaatacaacgtataaaattagtagtacaaaattaacataaagaggtactaaaagtatttaaagtttttatgctgcttgaattgaaacacaatgaaaaacccgagagagggtgagagatcgatgaaagtgagattgaacctgagagaggttcaagatcgagttgagagggtgaaagtgagattgaacctgagagaggttcaagatcgagttgagagggtgaaagtgagatttctaaaacttgaattataatatttcaatcatgtgaacttacagtttgatatgctcaccaatttataaattatattatgtttataaagttaaattgattatagaattgaaggtaataactttattgatgtataaattttattatgctttttaaacatattattaaattaaaaaaatgtcaaatcgattgaaaaaaaaatgacaataagaattgtccttataaaaccaaatggataagtcctcatttcacaatcttgatatcatcataacatgtattaaactaaaggtcatctaatggataatcattaccttcattttgtgatcattaatcaatcaataaaaataatcaaatattttaagatattcaaatacactttaattcatgaacacaagactaagatgaactcatgtttcccaaattgtaaattcaaacataataagatggataaaaagtaataacaagttgaaactaaattactgcatcatttcacaccggtaataatcactaacaaaattaggcatggctaaaacatctatgcaaatgatgatagcccataaaacttgagcagaggatcaagccataaccgtaatcaaagaaaagaatatacaatattttaacttaataactcaacgccataatttgttaacatgattaatcaaataaaaatagttcacgtcatacaaagcccaaaaattcaattttattgtaatttggtagtttttattgtcaagcaatataaactcaatacttacagttaaatatcaaaaaactaactcatagatagcaccatctattgaattggaggatatttttgaaccaattaaaatctatcaaacttcaaatcaacttaaagcaatatcacattatcaaaaacatatatatgattatgaaacacaagacacgaaagatttcattatgataaataatgatattatgtcatgaaggattcaataatttaagtcctggtacacaaactaccaatgtaaatacatacatgtctcacggttaaaagcctttgatcaaaatcaagcaattatagacatacaattttttttaattctactattttgaagtgttaaaagaaaatatattcatggaatactataacaacatattgatgatagaaactgagtgataaggaagaattttgatgatgcatatatacaacgagaaaaaatgttagtaatacacagacaatttttataatacttaatacaaaaaaaaatttaacaaaggagagtctagaaaaatatctgagttgaagcgcgttatgcgctgtctttacgacaatccattaattcaatggagtgcaacgaaatgatcttgaaccaaagaacattgggctccaaaacatataattgtaataatataatataatttaataaaaatgagaactaagcaaatggtattttgatgtaactgtgtgcgtctgaattttttcttcttattttttgtaagagaaagttatatataagaagaagcaaaatcaccaatatgcggtccaaatatcacacctaacaaactaataacaaacataacaataaatcttaaagcacaaatattttccaacaccaaatcttgatagtttaaaacaacaaatctcaaactccatatatcataatgaaaaatattttccaacaccaaaaccagggaatatcgtatgcacttggaagtctatctaaatctgggatattgcaattaagctatttgctgctgttatggccatttagcttaactgagttagttgcaattaatgatttcgtaaggcaataggtgtgccctccaaagtcgtgaatgaattaagatgtaactactagtagtaaacctgagactatcgtatgcacttgaaattaagtactactttgctgtctacctgaatctatgacactgaaaatgatcgatcaacatcaattgacaacataaggccgtttttttcaaccccttccacattttgctaacgtacttatccttgccaacattaaagggtgtggccgctggcgcgcgagcgagggtatgcattgcgtgtggtgcaaattatttatagaacacttcattcttctttgcacccgccatatctaatgggaggtgtttagtggatgagttccttcaaaaaaaattgggtttctaatataagaaactctttttagagtttcttatttttcaaacatcaccaatcaagaggattttttgaaatttattgtaattttttgcatttgaacaaaatttgattagagctcttataagtgacatgacaatgtaggaccacaaaaagatgagtaaataactttaaaaaactcatataagcacctgctcttccattgcaaaacaacaaggcttcgtcatcctctacacttacctgctgcttctgattcactcccataactgcttcctcaatgttgttctaccactgccacatatttagaaattgtctcgtacaaatacttggtttcaacttttctccatacgtcataaagtctaaaggagacaccattgttggtaaatgaaattctcatgattatcctatctaacattttcttaatagttcaaatgtactcttgttttcaatttcattgagatataaaaactttttatagtttgatttttaccctttttaattttactatcccttgacttaatacccatattaacgacagtgtatctaattacaatttgtttatattcaaatctttaaaatcgtccaggtcttattgtgaaaaaaaaaaaaaagctgccccgccacagcaggcgggttgcttcctcttttagaagaacaagaaaacaaatgttttggtgttcaaaccaaataaattgtttcatttgataaatgtttagaatcataccagtatggtagcacaattttctaccaacataaatctacataaaatgtattttctacttaaaatctaatctatagatatatatatatagtgtgtgtgtgtgtgtgtgtgtgagagagagagagagagagagagaatttaatcaaattttagcttttaggttccaaattcttaaatttatttcacaccccaaataatgattaaaaagttttaacttgatttactttattttaaaaaaaaattgcttaaaacaagttcaaacaccaaaatcacacataatgtatccagtatccgaacaaatatataaacagaacaaccaaattatatatcattattctaaaaagaaagcgtgtttttggtcaatataaacagaaacataaaaaataaagatatcgaataaataagaccaacaatgggctcaattttggagaataattacaactcacttgatatttcgttattccttgggccttggctttgaacatatgctgggccctagggtgcaacactgtcaaatgtcaataaatattagcagatatgcgttaattttgattttgaaatacaagcaatttgttcaccttttggtatgagcatcgattcctacttattaaaaagaaaattttgggaatatgcaatggattaacgtcaaactgtttcactgaatcatttcatgccagctatttttgtttaccaaacataccaggtaggcaagtaatattattattattattatttaatataaattacctgcttcagtcccattagtattgtgtaaatcaatatcaaaaaattgtgtttgactttattttatgtttttggtgaaggactttatacgtcacatttcacttacgaacgaaatagaaatttcactatttcagtaatagtaatgatactagtgtagcccatatttgggtggctatgaaaagtgtagcatgttttacaatgatttttatttatttctctcgtgagctacttcgagtacgttgtagtgttgtacacagcaatgtagccttcagatccaccattggttgaaaaacaagctataaatgacaaaaaggaatagcataatcgaaataaaattaatggtgataatgataaatgtcaaatttattgaatttttatatatattttgtgatatttacttgacattttagttaactttagactttgttttaaattcagtttttattttgtcttaggaagaattttatgttttagttatttttaataaatttttttatattttttagcaaaataatgggtaattctgacaagagttccagaggttcaaaatcagtagaaaattatgtaaggagaaattgtgaagaataaagataaaactaggaaacaagatatttttcaatgataaatcagatgaagaataagataattatttgaaataattagagatattatttgtttgtaattttttgtaatccttttccttattaaacctaattacaattctataaatagaaggttaaagtatccattgtaaaatagtaaagtcccgaacagtttttagaattatattttagacttacacctactagacacattcattattctattagacactttagatttcattgtattatttttatgagtgcaatttcttccatctaggaaaggaaatgatgaatcttgtttcactttaattttatcaattcaacacttcatcttaagtttttttatttgttttcatacttaatgtttttatttgattggtcatcttatagataaattcaagaattgacttgcgctttaacgagcctggttgaaactcgattatgaattaagtacttaattaagattatctcgagggatagaataatctggattaaatctcgctaattctcgaccattgatgttgattgtttgtatccatatgtctaagggattgagtattgggcaagtagtttagaatatgtgaccattcaagagctgggtagaatacattagtgaaccggggatgaacatgagagattactagaaaattgtgaagttacggtggatcgaataaattccaagtccaaacttagatattcattcatcaggatcaatgtcaccatcaaagtctaatatttctatttttacttaattattttattgtcatttaattttattgtaatttattttattttatttatttcgtgacaattacaaaaccaaaatacaaaaatataatttttagttaaataattatatgaaatttctgttttattattttaaaaaataacctgaacgataatttaattagtacatcgtaattgagttacatttaacctataaattaaatctaatatgaaataaaattttaataaataacaatcatactatgtacatgtacgtgattgttttagcttttgtgatccacgtttaatccaaattcactctaaagcaacctaaaaacaaataaaagttatttcatggatctacgtccaaatatcattggacagatcaccaaacatactatataaccaccacatccaaagtcatatgatctgaataatattattttcactatattttcacaatactttaacttttatacattttttctctatcactcattatcacatcattttatcttattttacacttttcttcctattcttcctatgattgttcttgttgtagaaattgttaatattattaagccttactagataactagtgtacaagtaaaggatctaagatccgagaaaaaagtctaaagggaaactttattcataacctttgctttaacaatgcagtatttggatattataagagtaagtattaatttagttctttttaatttgtattatttgttaattgatactttatattataaaaaaaataaaaatcaaaagtaagatattcttgtatttaagtaatagtcaattaatttggtctatgtaattaatgatattgattagattatttcttaaagaatttattatatatatgattgtttaaataaattgtttatccatcttaaatttataagatttataatatcacgtaaatttaaaaattttacacaaaaaattactttaatactaaagttactacgataactaaattttttagttacattaaattttggattgaaaaaaacgttatttttttttagtaataatcaattaattgtataagtaactcttttaaacaacacattatcaaatcatcatctccaataaatttttttattaaacaacaatatgtaactttaatcaactcatttaatcacccgctttaaaaatgttgtcagtattattaactagattggtttaactttttttactttagtaagccaattcaccggtctttgacgatagacatcaattaaatgatacacattcatttcatagatcaacttgatattcattctaataaacttgggtggagttttttttttttttttttttctttaggaataaattggtgaaattgtgaaatatacaacgttctttatttttaattttctcttcctcgtagctttttttataagccttgcacgagaccactttcatagcgagtttttccttaaataaaaatatcataataatgacataccacgtgaatggtctttatctttgtaccaaaggaagtaggttggtctcatcagtgtgatgtgcacttattgtttccttttatttatttattccttttctataacatgttttgttatttccacgatttaatattcccacgatagcaaaatattaatctaacaaattaatacatgagaatcttttataagttcagagttaacaaatatcaaaataatgtttgtttgtacgaaataagattgagagaaataatcttataatttttatagatattggaggtatctcattttaaggttgcgttaagtccaacttttttaaagtttttggtataaactataggtatgttttatgggataaaatttatcatagataacaaatttttatttacaagtactactatttaaaataatccctcctttgacacttcttatatatatagatatatatttttaagttagttaatataaaattgtataataacaattaagattagttagtgtaaaatcatgtaaaattagttgtgtttattattatcattgtaatgtttaaggtgataactagagtaaaattatgtaaaattaattatctgtttgttatttttatgataatggttaaggtggttattatttaaaataaaaattagttctaatttcatttgtgaaaatagtaaatttttttttgacatattattacttattaaaagttagatatttaaacaatttcaaataaaggggaaaaaatcaactcctttaacaagtttatggattcatccttgtttatgtcctctttgaaataggtgataaataaaagatatttagtaaaaaggaaataggaaagagatgagaaaaagagaaagagagattaataggaataggagataaatagtacattgaatttcataatttttaaaatcattttttatttaacttttttttttacaaaacaatccaactagtaatttgtatctgcccctcttctcccaatttatccttcacaaaataagcgcttttaatgtaaaagcttaaaataagggtttaaattaacaaagtaaaagttgtttgaaaattcttaatttttagtttgaattttttaacctatttaaaattaatttcttcactcaatgaatgatcagtgtgtctgtgtgtgaataatcaatggcacttacggtgttaaaaacttaaaggttagcttcgtgaagtcttttagtttgcgtggacaaattaatacacttgtttttttttccggctaattaataaacttgttaggttagataactataaaaacaaaacctgtttataagttttgtccttataaatatagactattagactgtatttaaataatcaagattttaagaaaaatgtacatgatttttttaaaataatcacgggatcacaaactaacttttcgtttattcaaaaaataaaaaataacttttaatcattgaccattcatttatatataattgttggaccaaaatttataactattgtttacaaattatatcttaaaaatcgaatttgaattcttagattgaaataatcctacatgaattgattgattcatgatttttttttttaaaaaaggagaattgattcatgctaattaatcgtatactgttatatatatatatatatatatatatatatatatatatattagtatattttataaatatatttaaaagttatatggatgaaatgagatagtgacggaccgatgaagaacggcttaaatttgtcgattccagaagaatttgggacccacgtcgacatcaaccggccggtccagcccaatgtagaaacgaagccggcccatgccacaagaacaaccgctgaggcaatatctaatgcctcgtttcttaataaacaaattaacccccccaaattattcatattgactggaccaataaaacgattaatagcctttttcttcttcttcttttgtttaaacagtattaatggcaacataactacagcattcagttttaaataactgttaatttcccccacaaaaaaattaactaaagtgcattaaaagtcagtgatatgtactttttagataatatttataagtttaattttgatttataggatttttatattatcatctaaatataagtaaaacaaactaacaaatgatagcaattattcaagagagaaaaaatattttgagtaatatttcttctaaattcatatataaaaaaaaagtaatttcgtatattggacttaaatataaataaatttaactattttttatatttaatgttattattattaaaataatatttcattaaattctaattataattctattttctatgattctgtattatttgttataataaatgttaataaaaataatttaatttttaacttaagattagtcaaattaaataattttatttttgtttatataaaatatgttacatataatcaatcgaattctccgtctggcatcataattatctttacatggtgatgtaaatagaattggatccgataaaaaaaagcattatgataatgaaacaggttggttgaaagttgaaacttttgcagaggcttatccatatcacaaacgccacacgtgatttcttccgtttggcgctagtgaaatgacgagcctaccaaacaagccccacattattacagttttgctcaaatccaaacaatcattttgtgggtcacatgagtgcaaaaatatatgtcaacaaaacaacgggtcctcacctttctccttttctatatttcactttacttttagtaattaaccaacaactaattagtatggtttaagaaagaaataaaatctgagaaatatacgggaatttttattttttttaaatatttctttttgccaaaaaaatcatcatgaggtgaaatgagaatttaatttaattttatcatttctttttttgcacatactaatatataatatatattttataaaaaaataattctcttaaatcaaataaaattattataagtaataatattctgtttcagatttgatttacagttcataaaattaaaccgtaaagccgtaaagaagtataatataagagtaaaatactttttaatgtttattgctacattctttaataaaaagtatttattgctatatgaaataaaatatatatacattcaataacataagtagattacacaattatgtcagtttattattgaaaaaaaaagtatttttgcttatgttggggattcttaaaatcgtgttttgctatatcggtgaaaataattttattatttttcttatttgactatcagcatgaagtctttgacacgacttattatgtaactatatttaaatattggaaaattttcttaacactctgcttgcacgttatgggcaatcggagactaccatccttgattctgaagatttgaactattccttcttgctcttgattttgactttgtaaaactaattgcggacaagttcatcggttatttttaaatagtaaagtaaagtcaaatgttactctcatgaaaactttaaattaattattaatctcccatgtttattaatatttgaataataaattaaaatgaaataataaattttattttatatatatatatatatatatatatatataaagagaattctataataagtactttttacagaaaaaatacataagtaactagagagattatatcacaacaaaaattatgatgaaaatttcatgtcaaaactattaggatatgtgtttacttaactttcatttgaacaacccaatgcgtgtttggaaaattttacattgatgcagtagttaagacaagtaattttgggaaatttttctttacgcttaactcaaaattgttattattaaactttcacttcgtcttaaaaattgagtatgagtttaaaagtcctggtgattggtgctcatatgcgcataataaaaaatttatcatattttttcatgctatggattctattattaatttttatattatatcttaaatatttttaaccaaatttaaaataaaaaataaatacttaattagaccttatacatttattctgttgattactatgataatactactgagtggaggtataaaattgatccaatagttgaagaaaaatgaaaagaaaatagaggaaagagagatagtacattcaaattctttcactaatattttcaataaaataagcattcaccaataaaaaataatagtactgcattcttttaaatatcatcacttattagtattctcatactaattgattacgaatatcttgaagtacagtgctaaaataataaaataaataatataatgattgaaataaaatatataatgtaaaaatatccaaaaaataaaaatagcacaaagaaataataaaattttatccaatgtaagtaaaggagaaagttaataaatattttaagaataaaataaaaataaaataaaataaaataaattataagctagaagttaatatctaaaaaaaaaatattacaaaatactaaaaaaaatgtttatcaaatatacttttgtctctaatataaaaaagttaaaaattaagtaaaatactcaccaaacatactctagaacaagagaaatattgttattacttatttttgttataatgtcaagtctaatttttaagaagagtatctattttattcgtaactgaaaattcaacacatggaggaataaaaaaaaaacatggtgagtaacaaataatctacacaatctaacaaggatattcatgacattcaaaacaccttttgcaatataacgtaagtctattgatattgatgacattgaaaacacctcttacagattcttcttcaaactttcctaaaatttattattatacagagtgagtcttatgcattaaaataaaataaaaatgggtatgaaactctaaaaaatatatatgtgatttaaaaaatatatacaatataattagacatgataacaaaatgaaattagaatgtatatggtttcttgttttcgtctcccaaaatccatcccaacctctattttcaatagagatgattttttatttaatgttctcatcgactattgaatatatttgttccttatttatattcgccctagaattttaaaaataaaataaaaaacataaaaaataatttaagaaagaaaaaataataacattttctataaaatagtgtcacccgtatatccaagaattttttttattactttattatatatatatatatatatatatatatgatctcaaatttctattcctattactaaatgaatttaagaatcaatcatcacctattaattattgtaataaaaatcttagaatgacatatttaattacaaagacaaacgataacaaatgttaattaagtaatatatattttacataaatgaaataatttatcacacaatatgaatacgggatattacatactcattatcgtttttcaaaaatcaaatattacctacatctgtatccatcccacaaagattctctggcaaactcagaacgagaataggatgatacccacagataccaatttatttgtcatgactaaatataatctataattctgcactatatatatatttttacataaatctttactatactttaaaaacattatattcacaaatatacacttacatcacatcaccactgtacaaaaaaattacatcactataaaaatactaaatctcatcataaattgtataattaaaatatccttatcgacatttacatgtatacctacaaatgaaatatttttaactattttcaacatcgtgtacagtaatggcatttacttacatctcatttataaatcatgctatatctttctttttgcttctaatcatgctatatatatttttttcccttctaatcatgctatatatatatattttatttttttttcttcttcttctaatatgctataacttagtaccactataccagcacgtttttttttattttattttatttatttttatatataagctattgagagtaaaacacttttttttttccaatttgaaatgagacggtgcatgaaaaggttgttgatgaatagaataatcaaaacaatcattttctttgtgaaattgtggcatctgaattttctggttcatttttatgcataacgtgcagttaacaaatcagaatcgttaaaataaaaaaaattaatagctcaaattctattataataaattaagtttaaaacatgaatttaagatatgaattttcttatttacatctgtcgatttagatttaatgattacattaatgcctaaataaacattgcacaaaattagttttttacgcttgtgcaaggcttgtatatcatctgaacggatcatcaaatttctttttgttattttgattttaaaaaaccatagttaaaaattaataattgttacttgaatatcaaataaaagaaaacatctctataattaattgttggcttattaaacaattatttgatattcaagtattgtttaacaagacagagtattgtttaataattttataaaataatcttttttttgttgtccatatataaatgaaaaatatataataaatattatattaaaaaattaaaataattattattttaatattctttttatatgacaattttaataagacaggtgaagtaacatctataaaatacttgtcatttttgtgtaaaaacaagcacctattatttttattgttggcgatatttttgtgaatgatgctttgtataaaatttcactttaaattcttttaattttttcttaatttttttatttataagaatatttatcttttgaataaataatatatgtataaataatgtaattttgtttataagatcatctaattataaactatcgttacttaaatttttttaaatatgtaagaattaaagataggtatgagaaaaattacaataatttacatatcttaatcaactaattgagctactcttaatatttatgcagagttatatgtttaatttttaattatttaataaatattgatataaataatagaatatgcaattatgcaaaatagaagtttcaagaataagacattatcttaaaaagtagaaatgtaaaaagtacatttaagtcatttaacatattaaacaaaataatcaattatgcagtttaattgattgactagacagtcatgaacttaataaacatcatgaatatcttctttaacgttctaattcttttaattttttaatatatgaaaaaggtgaaatttaaacgagtccccgaaaaatcaaaccacataaaaagccgagtgtatgtagcaaagcgaaagccacccaccagctcagatcagcctatttctccgttctgtttttacactctttccatgcaaaattcccccctaaatttctgggttttattcttgtccctctctttctagtccattcttttgttagaacactcttattacccatttcaggacttcacttttcctcatcattcctctctgtattttacatccatcttgaaggatctgtaattttcctgttttctttttcttttttccccattttcttggcacttttgttttcctgggtctcatattatctctctgtacctgaatattcaaccccctacccctctctcccccatttcacatttattaattgttttcattagactcacagaagagattttttgagctcaatacatcaaagtctcaagcttcctggggattcgtaaagggtctttaaaaaaaattccccttttgttatatgttttgaatccaacccttgtttcaccaaatcttgtttcacccattttgtttgcagcctctcctcacctaatctcaagcacccaggtccacaaaatggaccatttcacggtttcagactagtgggtaagttttcttatttgacaaggtctttccttttccaattcaaaagacaaccttgtctgaaaaccgaagccacgccaaaccccctttcgttgtggctatcttccattcgttcttgatctgacacaagaaaaaatgtatggaaccaaaagcaaaatagaccttgcctttgaataccaatcccaagttgcagttttgaggcccagtatccattccagaagagcaaatctgactgtgaaattccaagacctttatgggttcacagtggaagggaatgtggatgatgtgaatgtgttgaatgaggtaagggagaaggtgaggcaacagggaagggtttggtgggcattggaggccagcaaaggggcaaattggtatttgcacacaaccatagggcaaggcagtgccctcacatcttcattgaaattctcagcactggctaatgcaataactttgaagaagttgataaggaaggggatacccccagttcttaggcctaagatttggttttccttgtcaggggcagccaagaaaaagtccaccgtgcctgacagttattatgatgatttgaccaaagcagtggacgggaaggtcacccctgctacccggcagatagatcatgtgagcaactcacccccttttttttttcatgatcatcacacattgggtttgcttttgaatttgattacaattttcataattgtggttgtgggcatcaccctttatttgactagtgcttgcaggtgtgtggatcattttcaaatgaatttgatgcaggaattactttgtctagactttacattgtgtgacctgtgaaaagattttcagacaaaattttgctgcagattttgatggatgattgtgggtgttttcttttttgtttttcttcgaatgagcaatacttattatttatgaatgattcggagagttaaggaagatctaagagttgaagcattttttatccctgtgtttgtaacctttacaatcataagttctgttagccatattaacgtatcccatttaaataatttatttgttcttgattgcatggaatttaggttaggcaaaacgaatctttgagtaaatgctgattagaaagaaattgtaaattggggtggtatttgatacggtttgacatcagggtgtttgatgtgatccttaaaatggtgattggttttttatttttgttcgagaataatttgaacttgtctacatgttacattgttcattatatatatttattttgcttctaatcattctataagcatttttgcaggatctacccagaaccttccctggtcacccatggctggacactcccgagggacatgctgctctcaggcgtgttcttgttgcctattctttccgtgattctgatgttgggtattgtcaggtgggtttgctctggcctttcatttgtagttttgactccctgctcagtacatgaaagacaatgttctgatttgttattaaattgaaatttgatactacctatgtcttgtattaggtattaggtattaggtatttgaagggaaaatatcttgtgtcttttttttgagacgatgtggcttactctttgattcaatcaactctgcttctattctttttcttctgcaattagatattctgtcttctattagtaacatgcaggcctctgaatgcttcctttctaactaattaacaacatggtgtgactaaagcggggattagtttttatgttgtacctacattttgtttttctcaattgcttcagccactatatttgatgttttaaattttttaaggcaggtaaaatatagcgccacaaagtttgacaataatatgtggtttacttgaaaattaaaaaaattaaatgcatacttgggaacatattttcttaaatattgactctactataatattgctccagggattaaattacgttgcagcattgttgttgcttgtcatgaagacagaagaagatgcattttggatgcttgctgtcttgttggaaaacgtcctggttaacgactgttacacaaacaatttgtctggatgccacgtggaacaaagagtgtttaaagatttacttgctaaaaagtgtccaaggtaattttatttgatgtgttaactgtgtatcatatgtttgtttcttagtatcttctgaaaattgtagaaatggaaattcaggattgctactcatttggaagctttggaatttgatgtttcccttgttaccactgagtggttcctttgcctcttttcgaaaagcctgccttctgaggttagagtagtgctggaataaattattcattgaaaagctaaattgttccacatactaatacttcttccatgaatcagacaactcttcgcgtgtgggatgttatcttctatgagggtgctaaggttatatttaacgtggccttggcaatctttaaggtaccactagtgtagcctttttgatctttcttgttttttgataaacacacaaaatatagaaagagtttgctacattggaagggatgtttcaacaattgtcgccccaattgcagatgaaggaagatgaattagttataacccatcacgttggcgaagtaatcaatattctgcagattaccactcatcacctatttgatccagatgatctattgacagtaagacaactttcactatttcatatctttgtcatttgcactatcatcctttccatgttgtcacaagaagttttgatgcatttgttgaattaaactttccttgtgtttgcaggtggcatttgataagataggttccatgacaacaaataccatatcaaagcaaaggaagaagcaagagcctgaagtgatgaaggagctggatcagaggatcagacggctaaattcccttagaatggaggacaaatagcattttgctcttttgtccttttttttacttttttttttttggtggtgggggggtggtacgttgctctctctaaatgtcgtcctctgctgcctcgagcagaatgcagaatttatgcattaccttaaattcttatctccctcggggcaggatgtttgtaggtcataaagtgtaaatttggatatggacacatcataaacttattaatttaatgttataatgtgtatcaacatcaaaattcactgctgtggtacttcaatgcccaactcatttttagcctgttcaattacattctcttgcttagtgcctttggaccatgaatttttgaagttctggcaaaactcataattttaattgtttaattattaaaattaagaatgccaagtgcttgtaaaattttgaaacatcaactaatggataatggacttaatattggtaattggttggttgcaagtcgccacttacgtgctttattcaataggtattcttgattcaagggattagtttaattggaatgtttggttaaagatgaaagggaaacatcaacttaaatgcattttcttacacaggaatcatttgcatttgccatttggtaagttcaatgacaagaagaagatcataacgaatatcaaatcgctattgctttaccaaggctgaataggaaattaatgaaatatcaaaatgacgtattacggtgtgtatgaataaatgcgatcacgtggtgtatggttggttgagcatagaaggaaaattgaaaatgttgtgatgggttcatgagttgtaagcggtgaggcggaataactaatttcaaagtatttttaactgataatttttaactaataaatttttagttggattgaagcttgggatgagcaaaaccctgctagagtcactggccaatatcaaagcatgagtcagttttggttttggtttattgcataacagccacaaaacttggaagtgatgacctatttatatatcactatatttattcctagtatttattttcaacatatatagcttaaaaatttgtggcattgttagttgtaattctatttatattgttgatattaatagaattgctatctagccaaagttacagcttggtgtaagcctaatcccccaaccaaaccagcgcaaaggtcaatgataataattttaactaataattctttcttcttttgtatcttgaaatttgaattgtgtattagagtttttaaaattatgttttaacttttattttgctgtttaacgcgtcatgacagctgagctggatttcaaggcggtgccattgcgtccttctttcactagtcatgtactcatgttctggtgcaattcctcccccgcacccccctctcttttttctttcttttttttttttttttttttttttttttttttttactttggggcaatcaaattgcctacttcaaagatgctatgattttttaaattcttgtcttaattatcataacaagtaatgctaaccagtatttcaagtttcaataacaaaaaaaaaaaaaacctacttcaataatgctctggttaaagaatgaaaaatgaatcttttattaaaaaaattataatatttaatattaccaacatattaatattatgatttctaataaaacctttttattcattaatttcttaaccaatatatttaaaatattcactagcatgatcataataataataaaaaaaatcatatagtggacttaattactacttttcatctaacgacaacgttgattacaatgatatgaaatgagtttagatgatgacattaatttctgagtgtagtttgctatatatatatatatgttaatttgttatttttttgtttatacgtgagtttccaattattttgttatcagttcttgaaacgtgaatttgtatgttgatgtgtttggaccaaccatctacatcggttcagtacttctgctcaataatgacggacgaagaaagttgcaaagatcaacaaaagggtaaaatatttgtatttttataataatattagataattactgttacagatatatgaagcaagtacaactcttttgacttatttgaatttttatatttttaaatattaaacaccttattaataacattaatttttcttatctttctcttcttatcatattatattatttatgatatcaatatttctctttcttctctctatttctctcaaactgtcaattgattttggatgtttaaagacttttttcctatatgatacttgttcgacatgtgtcaacatttctcatcaacagtgtgtttggaatggttgtaagatgaatcaaaatcaattttgatttgactataaatatgaagcaacaaattgttgctttggaaaaatcttgttttcaggtagttttgagataatcactgtgattttaaaaatatccaaaaacatattatataggagatgtcaatcaaatgatttaagtgaaatggatgaaatgaataactacttgagaagttatctttaataaaaaggtgttacccgaaagaaattgtaatacacaggtcaattttaggcaataaaaagtcgggatagcacttattacataaagaacactagaaacttgccttaattatttgaatgtgtgaataagacttgtaaaagttctaatgaggaaagtaaatcaaatgaaggatagtcgaatcactaaagatgagatcaagaaaaatgataaaataaaacaattcaaagatgtggtcaataatttgtttataaacatgattaacaaaacattacgctacatagttaactccaactagcaagaaaatgctttgctattgttgttgcgttgttttatgcgagtggatgtataattttactattctgctggctatactgacaaccaagttaagaaaagaaaccaagaataaatctgcatttcgaggaaaacaaaaaagttggcatgaagatctccaattgccatagcatcaactacatgtattatacttcaacccgtatctgtatgcacgcattaataataatcttaacaatcagacggaaaataaaacgatgtcttcctcccatattattattgggaaattttgcatgcaattttcatcaaagaatatgcctaagtacaaaaaaattctaaagaatttacaagatccttctattatctgtggtttctcgtaacaataagctttctttcggactgggaaccaagaggttgacatcttccttttgccctataaacaaaaatgtgttttcccccgctcattctccattgagtatggtttgcttcaaccttactaacttaaagaagagctagcattctccgaagttgtatcatcaattgctaaattggatacctcgccaactacatctgtatcgctttcaccatctactgaagctttaggcgatgcttcaggggtgatgttttcttcaggtttcttcaggctccaatacatgatgctagcagttaaaatgagtatcatcttctggttgacctgttaaggttaaatgcataataagctaagagtcacacaaaatttctcagccaaataaatgcaagattagtgaagtatgtgggcaggaagctcaatgaacaaatatatttagataatagaagaaaaatgcttttccatgtacattatttatgtttaataaatgacaaactctccgttatatccaccagatcaattgttaaaacgtaccattccaattttaagatttcagaaacatcatcaatttctaatcctataaaagcatatctattggaaacaaacttcaaccaattaagtccatactccccttttcatagacaattggcataattaccaacaaaattatgtttaacatcgacaaacatacctcaattatgtcctcaggtaacaggaaaatggaacaccctagttttcgggcaacactgattatgtatgttgcattcaacttcttatcctcatctgcaattcatatgacataaatttgaccatttcaattgttgctcataagataacatattctcatcatattaatgtcaattgtcaaatataataatgcgtaatgtgaaattaaagagttgcaagcagaattctagccagcacaatttctcaatagaatgacagagttgacataccagtctcccctttagtaacaagactccagttgacaacccttggctccactgcactcaaaagctcaaggaagaaaacgccaccagaaagattcttatcctgatgaagcacaatacataaatatcaacaatgagttgtagtcatcaaagcaatcatcatgagcactgaaaagtccttttcttcattcaaaagcctaaataaaattacttttagtactattgataacagatgcctgtgatttttctcccaatatgagcagtacaaatatttaagactgataactgttataaataaatgtaaaattaagagtagcaagaactatataagcacacacgcacacacacataactctcaataggtggtttgataccttgaaactatccatttgagaagttcttcctgctcttttcactttattgtttgcccagtttagaatatcagcatcagtaatctctttaccttgtgagtgcgatctcaaatttctcagaagttgaagcatagtaaacctcatcagctgccacaaaaatgctgaggacagagaaaaaacagagatgaatatttcctacatataatggggcatatttttaacaaaataatgacaaataaaaatgttagaatataagagaaatatccaataatatatgtttttgcttttagtcataattttttttctatcgtgttggtccctcattcatctaccaccaaccctaattaacttgggttaaaggtgttgttgatgttgatgttgatgttgatgtgttggtccctcattattctagagtgtgtagttttagtccccaacttaagtgaatcaactatcaagatgatgtggctaacagtgagccaagccataattgccacatggctttattttatccaatatccattgtgttgccacatggctttattttatccaactgcccatcctccatattttacacttcatcttccaattttttttcaactatttcgttcattgaaggatcagaaataaatgttgaatcctatcaatctgataagataatcgatcttcctattggggtggggagaaaggagagacactgagacagtcttgaagaaagttcagatcttgtcctccttttcgaacttgaaattggtggcgtccaccacaaaaaatgaaatggcacccttcttgctgacctcgaagtagaagtttggtggagttaagacttaggttggaactgcattccatacagtaaaaaaaggaggccattgttgtgaagatttctttaagaggactgtttttcatacattgacaagtgagggatttgttcaaagttcacatgcgaagggcaagagggtgggatggagaggcgtggcacaataaaactgatgatgcatcttctatagccacacgagacaaatatatcaatcaacatttaacagaccccaattgatgtcgaggaccaaatgtcatcagtttggaacattgggggaccaaagaaatatgaaaatttgtattattgggaccaaaaaaaaacttgcaaaaatattgaactaaaaacatatttaaaaacctattttcactgtatatctgagtaatttagagtcttagattatctcaattctcaacatttccctatttccttatatttcaagatttgtttccttgtttaattaggaccatgatcattgtattactattttttttttgctgaaagcaaggtatctctatagtcgaaagccatgagactaatcctcagtagcatccagtcattctattattataaataagggttagagctttatgttttgtaccacatatattatatatcttgatttgtataacatgaatatgcaccacagagaatattctgatattcctcggtaataaatctcaagaacatatcctggctattgattatcttcagatggcagatttaactatagtgtagaagcataaaataatgtgttgacccatcaaaatatccaatgaatgaggacaaaacagaatttaaagcagatgttaaatgagagggtaccaaccacacaatcataacaaatttctagcactaacaaatcatcacaaagcagggaaaaaatgaaactcacccaataagagcttcttattcccttgtacaatatcattaccagcaacattcactaatgaaaagtttagttccttcccaatctttataacttggttgcagttctcaactttccgaaatggcatctttataggaggctttgtggccagcttccaattgacagatccaggtgaaaccttgtcaagaacttctaatagaacccatctgcggtaaaggaaaatcataaccagtagttaagatcaaggaaaatttcaaaagaagatgtaacttaaaaacaaaaatgataagaaaatggaagacacagatgatgagccaactgaacagtggaaaacttacccatttctgacatcctcaaaaacattattgacataagtggcaattccaagactgttaatccatagtctaaagcatcgttcttcccgagatgtctctgcatcatcagtcatcatctcagcaaaggacattttctggctgtcaactgttgtaaggccattcctacaaaagtacaagtaacagagatttttggatatatataaatgaaactcacaatctaaatcagctcaagatccaccctgtactgtatacatttctaacttaataactttcactaaccctacttacttgtacctaacaaatgaatcaaaccagtgagatccattacttattagtcattactcagaggcctatttaaggataatcataacaaataaaatgcataagcttaagtggcaatgttatatgatataggagccacacctatccaaattcatagaagggcagaaaacagcatgggttcttggaagcatatcccaaaagattcttattgttatattgtatgaatttacaatgaaataattagcacatttgcaatcccttaaaaagaaccatacctatgctggaaaatttgagcaacaaatgcaagattaagattaggtgacccctccactatgtcctttggagtaaggtatctcttgcaatctaatttctctgcctgctcaagaaccatgtttgccctttctgttggatcacttgtggttagggcagatggacctgccacttctggggcaagagcattaagcaagtaagcataagcctctccatcctgcgaaaagaagattattgtagatataatagactcatgcaacttagaattatactatatctcttaacaaatgccatgcacataaaaaactagccacacaacttatttttttttttgatcggccaatgttagttgttaaatgttagtttttttgttagtggagggattcgaacccacgacctctccctccttcccttccttcccttcttttccttttaccacccaaccaacctttttgttagtggagggattcgaatacacaatgattcagcaattggcatgatgtagggaaatatagtgaatcttttcctttgaaacttgtagatggttgtcaaggccagcagaatataacaagaagatccacagtttctttactgatttaaaaggcacaaaaatcaaggcagtggtgtgtataataaaaggttgttaataaggaatactggataatatttcatccatgtccagaattatttctattagagtaagtcagcatacaaagttagtaagaatttccctcacctttaggtcagaagagaagtttgtaacttgtttctcatatccagctttcttcaagtggaaattcatccatttcagtaagagcttatcaggtgctaaactgataagctcctccacatcctgccagcatgttaaatataatatagaggtttatttcaatcacgtttctgacatatgtaaaggaaagaaaaccattgtacatgtaaattacaaataagaggaataatattatccaatatcaccttgtcatcttccactaattccacaagttgaggagttttcttcagattgagatcagctaacaattgaatctaatgttgccaccataataaaaagttaaacaaacaaaaaagacagcaaaagtttacatgtcttaccaatgaaaatggtgtcaacttcctcatctgagttccatattaagcaagaaaagggggggaagtttccgtagtttaccttgattacttgcgaaatcaaaccaagtaccagatggggctacaaataaccaaacaggaaaattttcaaaaatgagttaaagtcggtcaaataaaaaaaaaaaaaaggaaactggaaacatggagaggggaaaaacaaggattgaacctactcttccttcaattaaatcctgtgtaccaatattaaccaccgtgcacccaatagccttggccgaattgaggccaagggtatggttctcattcctttcccatggattaagaaccttttttgtgttaatagctcgatcatctatggtcccaggaacagcaatattaataagcttgctgcagcaataaaataaacaacaaagtcagggaggaaaaaggggagacaatattttttaattagctgatattgagtcctgaacatctaccaaagaaggactccatcttttgcaagatcaaacaatgcatttgttgatggatcaattggaagaaactgactcatgaatttatcttcagccaagtagttgttaatatgtgcaacataagaagctttctcagattcattaattgcatgatgaacagttgttgtagctgccttcaggaatgaagaagaactttttgaaccaccatctttagctattgctcgggattgaagattcaaatgtgcctgccatccaatgtcactgaataagttgctaggtccaatataaatataattaatacctacaaaagtactcacaaatcgcggtttcatgttaggtgcatatatatgtgaagagtccaggcaatatgaacatcaaatgacattgtagtgtatattttccaataatttctttgagaaagcaataaacagaccattctaaatacatacagtaaaagttaaattaagaaacacatgaacacataggaggaattcagaaaccatgccttaacttctcagggggtaaaataaaaataaaaaaacaaaaactcaccctaaggaaggactcaaaatcaatctcttcatccatgttctgatatgactctgccaaggcatccttaatctcatcctcggtgaacagttcagagaaacccttcaatttcttaaaaataggtggcaaatttccgacagtaacacgtcccgattgagtcctttccgacacatactagaaagaacgtaacaaacatacacaatgcgtgttctgagtccgagattgtggtgtcgaagagaaaaaaaaaacatcagaagagaggaagaaagaaacataccttggatttgagggttcgaagttcgacttgggtgaactggctctgaagccattgatcagaaacaaggacaccgacgaaactagacatgttcgactcggttggagaaaaacaacaaacactcggaacaacacacggaaatcaaatgtttataagccaatagagataacacatttgttttgaaatcaaatcaacgatgcgtgaatatttaaattacaccgatccaacagtagattgcgacaaggctggcacgaagcgattgagaaaggagtattgagaaaacgtccctaagaaagtcagaaaaggagagcgagatcaaaaggattcgtcattgtatttgcgtggagcttcttcttcttcttcagagagagagagagagagagagagagaggcttgtgttatttgattgtgcgaaagaggaaatggggtggagagaaaaaaacgaaaggacccgcgaagaaagggaatgcaacgcaaatactatcgaatcaaacggtaccaatacaatgcttttctttctttcactcgttagactctctaatgatacttttaagttatttctataaattttgtttttttttagttatgaagttaatttttcattaagacttagtcaaagttcataatctctatataaaagtgtattttatgaaaatcaaattcaaattttttcttataaatttatcgtatattatcaattaagatacatcaattaaatttttgttctatgctattgcaagtgccaattgctaattgctaaatgatatatatatatatatatatatatatatatatatatatatatattaaacaagaatgacatgtggcatcaattcagaatccccacactcctctttccttcgctttcgtattgtttttatctattttgttgctttttcacaagccaaaaaatatctcatcgccttctacaattttttcgtcgttattatataaaattatatatatgtaatgttcttgatctcgtgctatattttaccataaagtaaggttcggttcaagggcaatccaatgaattcatttaaaaaaaattccgaactcagactcagtaacgacatttatttccgctttcctttatatacatccatacctaaccttcgcacgtttatctttaagatgaagatatttaagtatctgtttatccaaaaacaataaaaagaaagttcattttcatcgcaatcaaaccaaatacaagatttaaagaaaataacaattttaattcttatctaagaaaatcctattaatcttcttatttattagataaaaaactattgaatactttctaagttttcaagatattaaatacatttattttttatttcatataatttataaaataataagaatttttatatggaagatttgcaagacaatgtcacattaaattataagttattatgcatgtattattaattaataatctagttaattagtgttcttataatattggtggaattaaaaggaaaaaacatttagtataaaaattatagtaaaacacaaaaatattatgaataacataattttttattttttaataaaaatatttttactttatgttcattaatggtatgtttttatataaatgtgaaccatcatttccaaaactttcttatttttaaatgtcatgttgaatatgaagcatgttatacttagacgacgaagatagttaaaaagttaaaattgcacacaaatagaacggtgtgcatcataaaaaggaaggtcaactcttttctaaatgaaatatagccaacctcgtgagagctctaggtccattcatgtatggtccaatcccttaactatcacatgcaaccgctttgacatttactctagttgacctttaatatctatctaactgacattaaaaacaccttttattttcaaatgttacttcaatgttaagtttttcacacgaagttgtacaagtatttaacttctttactagtcacttatactattaatttgtctaatatataagatggattagatgcttgggatgacactgaacgaaattgaattctgattaatgttagccaagatggacttttgagtggactacaatttgagattttaagcgatgtgtcttctagcatggacgagatttttagtgaaaaatggtaggttcctgcaaaaagatattacaacagttaagttataaaggttcctccaaagagacacaatatgtattaaatatttagttgttaagaatataaggacatatccaaatcacacatatatgatttctcatcatgcacacgtttaagacaaatctcatcaatggttagttgcaagaaagcattgagaacagagtacattactcaatctcatgaataaaactttcattaaatgaacaacagttcaattacaaagtaagatttaatatttttggtccttaaacttttaaaaaaaattgtttttaagtctctaaacatttttttaataatatttttggtctctatattttttctctaataacatatttagtcccttcttgtgattttgctagtagtctagtgtctcccacacaggctagcatcagggaccctggaacgctatcgatgttcaacatttttttgcaattagagttcgaggagttggtcaagcgtctaggatgttaactggcatttgggaattgatatactagtgaatagtgatgctagaacagtgcatcgtttaaccttttcagcatttttaaacaccaaaaatttgttttcttacacgattaaagttgaaaacattattagaaattcttgattccaaaacaaagacaatgtattgttatttttatacaaaagttaacaaaactacttaaaactcaatatttacaaaaaaaaattttggtgcaaactcaaattctactagtttctatctatttttctaagatttcaatatttattttgcttttttctcttatttttttccttcaaaatcatgcacataaatttatcggctatatttataaaaatacttcctaacaaatcaaatagggacttattaacaaaacaaaagcaaaccataacagataaaataaatctcaacaaaaagaaagcagacttaatttttttaaaatatattgataaaaaagccatcatggtttaggttatgttgagttgaaaggagagaaatagtgtagatagaaataaaaaagaaaagtaaaaatatgtaagaaataaagttgtttgattaaaaagaaatatgaaagagataaagagatgagtaaaaataggtaaaataataataaaaatgaatctcattatttttaaaattatttctcactttatagtccctatcaaaccaaaaacactaatttctcaaaattgtttcattgttggaaatggacaccacattaatacttgaaatcctattcatgatttgaaggacataataataactttgtttatttttttatcaataaatattaatttgttagttttttcaaaaatgtcagtttgaggattcgaatccgagatatgtccccccttccttcattattcttcaaccgttggactaaccttatatattcttaacttagtttttttttttttttttttatttacaaactaatcaaacaaggagttgttcatttttttttgtaatcatgataattagaaaaaaaaatcattttgttagaatccccaggcatttcacaaactttgagattttgagtatgatataagactaattttcgatccgagacttaattacaagctcatcatcactccttcccaaaaaagtattatgtggaaattgatccatgatcttccccactaaactataccaatttgataataatcttgtttattattattttttaattacaaaaatgtcactttcatttgaataaattttattattttccctaggtccgatccctctgaaacaaatacttctgaaataatcttgtttttactttactcagcttctggcctggagtccaactggaacagtaaaggtccaaactccaaaccccatttgcatttgactgatagatgcatccagttctccaaaaagaataaaacagtgagcattagcaagcaaagaaaagatgggaggagaccggaagaccaactttggctaattttataggcatccataataaccctttaatattaatgctttgatgcagtggcgtttgtgcaaccctcttaagagttaaggcatacgtaaagagcaaaggaatatatacacttcaaaattaactcagcaaaaagccagatttaattccatctcaagaagcgtatcattgaaaaaagctcaacgcataacataaagctatagcctttcatgaatcatgatcaaccttaattaccataatgctatagattttaatgatcaatcttagataccataaaaaccttaatatacacttctgtctccactataactgttattggaattgtgcctgcctgagtgaaactgtactgattaggtgaaacaaagtcgtctagctcatacttgaaccaattttcaattatctttgtagttattttgaaaacgacattgcaaagatttgttggccaaaattactttagcaactcacaattatcaacatttctttttcgtcgaggaagtatcaatcaaatacagtaggctttataaacccaacagagcaaggtagcattggaaattgacttcaagacttcaacaccgtgcgagttttacttacaaggaccaaaaaactttttgtaaatattagagtttgaattatgaaatcgctaggcacccaaaaagctgtcaaagacccaaaaaaaaaatgttaataatacttacaagatctggattgaaaaaaatatatccttgattatttttttttcaaaacggcatctcctttcacatgccactaggataggaaaaataccgggtcttcaggagctggaacgttaaaaggtccaatataaaatcagcatctttaatttaatttcagctaccgtaaaaagagcttgtaaatcatttgatttccggaaacatccctttagagaataaaatcaactttcggaatagactttaactttaagtgacggcattaaaactctcaaaaaaaggtagataaagtcataacatgacaaccacataacatgacatccgcatgctatgagatttaacaaaaaaatagtataatagaagaaatcacattcatacatacattgaataacacttatgttcaaaaaaatggattcaaatcaaagcaagtggcaccaaatgtagatacataaacataatctaaattaaatattcaattggaagagtgccatcagaagagcaccagcacaccaaaagttgccaagacaaggttggcccagattccatagctgatgagcttgtgagaaggggagccatcatgagtggatgatggagatgatgctttgctatctgcactgtgttcagttggagaatcagcagcaggggcaatatcaggagttggtgcaggagcaggtgcaggaggaatatcagtgccaaaaatggcctcagggagtagcaccttgtcaacttgatatattgcaacaggatctgtggcatgaacagcactgctcaccctggtcttggaccatcctgaactaatgtgcaccgtcccagaattatcagtgaaattcaaagtgtaatcccctccggcaaatgtgggagtagagctggtttggctaaggcttgtgaactccgccagagaatagaaatgtggcaaggcatggaagaggatcacttgctttagctggttagaggtgaggttggatagggtagttttctttacagcattgaatgcactgtccttaggaacaaagatggtaattccttcttcagtgttgttggcttggttttggaaagtgtcaatcactttagtggactcaaggtatccaaggaaggtgtgaaatggaccagcaacactgagtaactcagttaggttcacgaagtccggtgccggggctggtgctggagttgggctcagagagggaggactagcagttttggcaaatgctgaactgaaaagcagcataatgttgctaacaatgaaaatcatagaaaactccatatcttccttggccactggtttatcctaccttgctatatcaacagtctctccaaattcctgtatgaaaagagctccacagtggttagatctcatcataacaaaacctaccaacctgtgaaaaagttaaataatgcgggaataaaaaatgaactcccagttcaaactcaatctccaataaataaaaaatcataaacccctcaattttttttttttacctaaccttctttacatctcagtaaaaagttgtcaacatcttactaataatagactaacataatggctggaaccagatcttacaaaagttaacatagaggaacaaaagaaaaataataagatattcaacagaatatgaaatgcacaaggtaagatctatgaatgcgaattgaaccagagcaagcagaaggaaatgcagatccgagtatgatatgaacactataacaatttgatagaagcgaataacacttaaaatgtactacttttgcttcacactactgaaaaatgttaaattcagaactcccagaagactaaatttccaaatgctaaattcgagatcagacagacacctaatgaaatgaatgttgaaagattttctattttcttttttgaaactatcaatcatccccccccccccaaccagtgccaatggaatgaatccattactagttcattttcctcacaaagtttctaacttgttgtcaaacccaagccaaacgtaggtgagttagacttagaccagtcaagtacacagtgacagaattcacataatttcatgaaccccataatgaaatgagacagatctagactagctgatccaaaatcacaagcacccatgagacaaaaatgacattcaaatgtgaaaaggcaagaaaagctaaaagtttgcacctaaccataaattgagtgacattcagaacaaaagtaaattaaaggaaaggaaagatattgagatagaagagcacacagacatgaataagaggaattcagagagagagaaggagaatgtgaaggacgaggaatgagaatggaaggagggtatataaagatagaatggagggtacgtataccagctggaagggtattagtattggctacagctacagcaaagagatgcttctaacttgagggtggttctttggtgaagacatattatactttaatggaaaatgcttctctggaacacacttttttctctccttgtatggtggcctttccatatccgctttaactaaattacttctttaacccatcatagaccaaccttgcactctaccccaccattttccatctccccattttatcatctagctaaccgacatacataaatggtttctacttcatttctagtttatttattttcatcaccaaaaatgaagctgacgtttagccctccataccaatgcggcaatgctaatatccgaccatgctgttcacatgccccaaaacctacaatggaaaagtattttttttctaaattaaattatcgtttaattcttgaaattgtgtaactctatgtcgttaacttttttaacgttaaaagattaatttgatattaatttatattttttaagaatcaatttaacattaaattatataataatacataattattatattttttacatatttaatttattcttttgaaaactaaattgtcattaatttatatatctagggagcaaaataatcatttacctttgatatgaactattaagtgcacatgactacaatcaaagatgtggtgactagcatgaaataaaataaacttgttttctctatataaaaaatgcacggagcttccataactatatgaaaaatgaatgtgagatcaagttttttgataatctcttccttgcatttctctttaactctttaagtcctcaaactatattgtttcacaataattaattttttttgtgtcaccatggaacacatgaattaactggtgaggtttgtttcaatttaataaaaaacctcaagttaaagttttaaatatgaaattacggaagagttttgtcatttataatgatattattcaactcaaataaaattactttttgtaagatatatgtgatgtaggaaaaaaattgtgttaagtttaactaactaaattttgttccataatattaaattaaaacttattatgcttatggttaaagttcattactcataatttccgtataccatatgtatataattacggacattatggatgctgggcaaaatcatattgaataatcttttgtaggttgtcaattcaagacttgtaataggcttagtgctcaagatttattaaattgattgattaggcttgtgtaaccatcaaggcatatataggaccacgttttgattttccaagacactaacctgtctagaaaatcatcattagatgcaattctaacggactgtagcaatgtttccctataaaaaaatggactgtaataatgttagaaaaaattatgtattcaagtttaatcagcaaatgtaacaaaagtggttagaaaacggtaactaccgatggataaggcgagtactgctagcctaaaaaataagacatcggtcataagagaccaacattatggtgttaaaacgagttaaatccaataatttgacttatataataagttcaaataggttgagttcgactgggattttcgtaactcgtataacccaacccatttaatccatcaatcttttaaattacatttaacatttatatttttttatgattattggttaattatttatttgatttactagtttaataacatgtttttttaattatatttgaaaatcaaatttggaaaaaagttaagacaaataaaataatttatttatttaattttattttttaaaagagttgatggtccaacctaacccatcaagaaaaacttaatacaattttggtcttcttacttagtttcaatttctcgttttttacatcttgcgccctcataattttaagtattcccaaattacccttcttttttctcttaaaccttatttcctgcacattcgactttaaacccccattatatctcacccttcattcccttcttgtgtcttcctccttcttgtacttttttttatcagatctaatttgcggatttgttaatctgtaatataactttttttctcttatgaatttgcttatccggaattttagtagcccaataaaatagattatttttccatttttcattggttgaaaagcccggcccacatacttcaaattacattcaaaactcaagcaaccggactagcacaaagattattgtgtcccaaatttagattggcaaaagtaatgcagctaagaagagatataaaaactaaagaagttgacaactagggaacttttattgggaaagttacaaaagagtcctctttgcctctgtctattttagtcaataccaaaaaaaaaaaattttagtacaaacatgaatttagtacctaacatatatctgaatttctcaagtcaatacaatagaaatttgacaaaatgaataagaattactattgcagatgcaaattgggtatattgccatcttcgttcaagcccattccttcctaatatcaaaagtatagttaatctccaagtagcatttgttgtcatcatcaagaaactgcaaaaagaaaaaatatgatagtatatggttgtatcattaattcattatcatacaacaatagaagaaaatacaaatgttattctatcccatagtatgcagtgaagcaccgcttcaaattttactactatgatgatatgcaatatatactattaagaacaacacaagaagttggtgaccaacaaacctcgattccactactgaccgtaatccatttacaaggaaactaacaccagaatatattaaattaaagccagacaatatggtacttctaataaagaaacattacaaaaaatgaggaaataatgaaagaagtaaatggaaaattatggaagtgataaactgaaatgacaaaaccatgataaacttcgaataaaatgattgagaaccctttgaatcaagtatagtagtgattaaagggacgaatgaataataggtagccccacaccccaggcagatagtgagccgtcgtgactattttatgcaacatttaagaggaatatatataatccaattatgaacctgtgtgtgtgagtgcatgtgtatatttgtacaatcaagttcaacgtatttagaagtaatattacctttgatcttgcagaatatgatcctcttgcaaatagcccagagggagtggtttcttctggcatctcatgtgtgtaaggctctgcctgagggctgaaagttcctagcatctcttttgagctatccactgaaattagaattgttgtaagagagtgcttgatcaagtttttcatgtttataagtttaattaatttgaaatagatttggcacaaaaaaaaaaacttacctttgacaccagtcttccaaacagtattggtgtatttcaagccagacacaatattattgctcacatggaaggtgaatttcaagcggtaatgactaccttctttaagagtaaaccataaaccctttggattcccattttcaggaatggaaagaacaatgtcatctctatcaggagagatgatagacaaacaagtaatattcacttcagggtccagaatttctggaaataaaaagattaacgtaataattgatacaggtttagaaaaaaagaacatataaaagaaataaaagaaatcttctgattattgttcacaaaacaaaaatcccaactactagttttgaagttttaatggattatagtgaatattatgatttctcaaactgttaattacatgaacagaaaatgccaatttgcatgttcctcatgttaatcttcctgtagttgcataagtcaacacttacatttattattattattattattattattattaattaaacagtaataactaataacatagccttatattaattttagaaataaaatataatgtaaatttgaatattataagctttcatgcttgcgcaatagtccgaccaacttgaacagaataagtcaaatgtctaatgtgttctgattcttctgaatacaataaaaaaagaatgcttataattaagggaaaaattaattaagtgatatataaacctgcagcattgttcacatccacacttccaaggagttgttccttccatcttcttaaactctcatcatcctatattaatcccaaaattcaaccaaaaaaagaaatggaaagaaaattaatcaataaggaatgaagcatgaaacatgacctgacgataaatttcagcagacacagagaaacaaaccttatctttctcaaggtgctctttaagagtgcactgaggacccaattgtaatttggatccaacttcatcctcctcatcttcagttgcatagatagaggactcactcacgtgcctgctcaagggctcgccttcacttttataatgttcttcatttgcatgatcacttttctctccagtttctttgttttcatcgaaccccatcttcttggaacttgaaacagctccaacagggaaggtggttaactcatcaaccgtcacagggaacaacaataatatgaccaaaaaatcccaacaaacaaacaaatggaatataattaagcaacgaagactaagtaaggcaacaatgggtaaaaataatgttttgaagggattagtgaaactgaaaaaaaaaacaataatagtttgtgtctcacaaaacctaacaacgaccaataaccagaagcaaaaaaaggcaagggatgtcaaaggaaaaatggcttgtttgtcttgttggcaatgttttaggaagagacataaatttatggctaattttcggaaatggtcatgtggtgatccgaaatctttgtaaatgttactgacatcatgacatggttatatatattgactcatctgataaggagaccaaaaatgttttggtgaattttcatttcaattttgtaaattttaggattaaaaaattatatatcttactatttactgacaaataagcatcactttgaaaatataatctttttaactaagatgatatacatgagtcaatgaaaaatacagtaaaaaaaatgctcttaaaatatttttgtaaatcttctttttatctttttatttttatcgaaatcacttgtgttgctatttattgtatgttaagagtatatttttattcaaataatatataaaataaatattaagagagaaaaatcatgatcaaacatttattttttattttcaagtctatttttcttatatgaaaaatataaattcaaaaataatataaaaataataaacaggaatatataatactatgtaattaattgttaaaaaattatttcatttattgttgatatgatgttaatatgtaattttcaaatgtatttattatcaaaattaaaatttattttaaatttgttgacatagtataatttttattttatatatatatatatagttaattgttttaaaataatatttttaatgattttaaagatattaattttaattatgtgatattaatgaagatttcaattgattaaattaatcgcatcataaattgaatcatatcaatgattgttgaagttaaagtttcgatctgatgatgtaaaaatattgaaataaagactatataactgaattagattaacaatcatcattatgagttaaaattttgattctactactctcaaagtttcaattgaagtttagttatgtatgtatgtagatagatgaacctaatagctagtgtaatagggatattttgagaaggtgagaggaaatatggatattttgagaatataaaagaaaagagtggagagagtaaagagcaaaaagagggtgtcaatatcatgggcatttccacgcaagatagcagacagcccactaaactacattcaaaatttatcaaaggtatcatatgaaatgagacctaaaagtacttgtgtcaccgattctcatatactctatcataaaaagtatagatgataatttcattaaaattatttacttgtggagcataaaagtaaaaggttacttacgggccttattttgctaataaaataaacattggatttttttttttgtttcattttttgttactctcggattgcaaaaatgcagtcatgatgtcagcaacatattaagaaagatggtattgttgcctagtgttttttactaaggcattatttgcaccttttcaaacctcggacaaacacattttgcaagaattttttttgtctgtttccagatttacagctaccagagttactgttatgtgtgtggttgttaggtaaataattccaatgtgaatggtgatgtgatacacaaattgttattcttaggcctcatcattctattttggagttggaggcaaacaatgatcggcaattctgtgctgtgggttaaggtcttaaggattcttgttacgaatgttatgcttaagatctcgaatttaggacataaatgtaaataattttttttaatttaataaagttcgggtagttctcatttttatatgttgattgttagtttgatggaattgaattagatgttaattctaaattcaaatatatatatatatatatatataattttttcccttaacatataatatataaatgtactcttagtttttaatgtttttatttattatatatatgtgcaaaaattcatcaattttgtttatgattaatttttatgtgagaaaattttttagtgagatatttttttcaataatttttttatatatatttataggattcaattctaagattttatttaaaaaatcaaaacttagttcaatttggacaaacataatgtttttaggctttcaatataataacttaataacttaattcatatttttataatttaaactgtgttaaaagataattggcaatttattataattacaatgttgagatccttgtgggaatgcatgggaaatcggagaatggataataagaaacaaaattagcttaagaatgaagataaatgaggatggggagcagagagacacactctattcccttcccacgcgagtgccatgccatcacaattgtataaatagtagtgtgtgacaaaactttacccgttggcaaatagcacacacaacatttcaatggcggcatgattatgcatctattttgattttgccattatagtctcattctcgtaatcacatcagaatcaaaaagagaaagcagccacaaaaccactactacgtggtaggtgtaatctgaatgggcccagatatgaatatccttgcagggcccactatgggtccaatggcccaccagccgacaaggcccagatagatagtttaggttttcgtcagggtctgatctggactactacctgctaccgtacggtttcttcttcattaatttatttgtttgtttgtttgtttgggatcgatgaaagatttcattccaatgcacacccaaaaaataaaaatataaaattattgctaacctataaatttacagtttacactttacagcgatgctaaaatatttacaatttatatatattcataatgttaataaaataatttataataaatatctggtaagtcgtagttattttcagattggaaacctagaatcgtgatttgaattaaagataagtttttattcaaactatgattataatttaagacttcccaaactaaaattattttaaacctctcaattttgaatacaaggttatcactccattgacttaggctcaaggatcgaccctaacataatgaaattggatcctctcttgctcctattgtctctccagcacaaaaaataaaattagaagctcaaaaagaatgaagagaggaaaataaatgatgaaaaagtaaatagaaagtagagagatagaaagactagacggaactagagagaggatattggcaggagaagatccacataataatctaatactcccatctcacatatgtaaatttaattttcatagctaataatgattatattatattcgaaaagatatttcaattaatttttatatgtttttattgattgaaaaaattgtttaactgtttagtaaataagttttttaataactttttaataatttttagtatttattgagttgttatttgaagtagcattttttaaatcctaacttttaactttttttatatttttattctcttccatatatttatctaatttcctattacattttcaaataaataattatttttatttttatgttattttatacatttgagttacttcaatagttagttttaccaaattcttataaattcttataaataaaaagtgtaaaataacaataaacaataaaatcatttttttttcaaatgtaactaagaaatttgatatatatatatatatatatatatatatatatattaaggataaaaatgaaagaaaatataaaaaactaaaaattagaagataacattttaaaaaatgctacttcaagcaatctttcaaaaaatgctagaagctactaagtttaattattggataatccaataaattttttagctaataattttttttttagaaatgagttgaaatgttctatcgaccatatctttaataagttaacatttcagttatcaactttaagcttttgactaaattttcaaataattttattgaacataatcaataattaaatgattattatcatttccttacaattattataattcttgttcatttattttttaaaagcataatagttttttgttacgaatattatgacgcttttgatttcaccagtttgtgaatatgatggtacataataaatattttattataagtgaaagttacaaattgatatccaatcaaatctttctatacatgatttgtactactttcgtatgaattttttctgccattaatttttttagtaattttttaaagatattcattcatgttgtcatcttgtcgcccttataataattgttatcaattgaaaaagttatgacaagtaactttgtgcaaataagaatttagtcttcaattataataagagatcaatcttattatattggatatcagataagtatttggcctagtcgaatattcaaaaatatatttgataaaacttttatagtacattgaagtatatcctctagaagtgttaggtattcaaccatattgaatatcgagacattgttgtttccatgttattcaaagattgttatattcatgattgctacccaatcactattagtatcctagccttcaaaggttgttttctgttcatggcgtgccaagtattcggccatgttgaatacccaaacacttttgttaccctgattcccaaaggttactttctctactcatatcactgtgaagtattcggccatgctgaataatcaggtactgtatcacacactatttctataggacaatatgcgagtattcgacatgattgaacacagaacactctcacctcaccttatttaaaggtaagactatctaaattagctaataaacaagcattattgaaaaattcaactctttaatgataattaaagatacattagctaaaaaggtaatattgagaaacggtacataggttcaagccccactaaagtgtgtataaatagttacatgaatattgaggtataggtaaaattactgttaagtcttatttattactcataattattgttatcaaccaagacctcttacttgaactttaaagtgtcttttgtaaataccctatcatttggattgccgaacattatttgaagaagaaaggagatcatctaggagaattacacaagaagaaaattatctatctacccgttataatttgagtatcctgtcattaaatttctcaaagatgaatttgagttgtacataagaaatgtactacagtattatttactgttaaattagcttaaagaaccgtttgttttaaggacattgcactttttattattttacaactaaatcatgattgaataaccatgcattgaatttggtaaatccccctgtaaatccgactgcacaaagcacagaatgttagaaccaaaagaatgatgatctcaatgctccattattcagcctcccagtagaggagatctgaaataaccattataaaataataatataacctcatctctaagcctttgtcaccattattgccaaacatgcttattaacattcagtgaaggatgcgtcaaatcccaagattcttgaagtgtccccacctctccgtttctctgatcaacttgaggcctttacctctttataaaccactcttaatgctcatttcttttcatcaaaagcttttagctttctatatcactctcaactttgcttcttttcaatcagttacattttctttggtattccaatggccactgtagaggtaactctactaaaatacttgctactctagttcacatggtagctcagttcagaacccgcaaataaattcccttatgttaattttaatttggcatcaatttcttttattttcagtttgatctcaaccatatacttgcttcgttttttttttttttttaatatatatcatcatacccttcaccgaccctaattaatttggattaaaggtgctgttgatgttgatgatattgatgatcatacccttgcttctgtgttatcttagacaggaagttattcatttctttagcttcaatactccaaccgtcattttttttcctgaaattcttgtcacctaattaattaaattcagtaaaatgacagcaggcacttggcatcttatcaatatatatatatatatagctttgtcaaaaagagttcatatacttgttttcctcagaaaattatatagaaatgtacaaagtagctgaatgcaaatttcaattagtttgtcatcagacagagaagccacacgaatcatatgccttttccatcagtcatatttgttagagtattaaaagacgtattaaatctatattaatctgacagctttgaaactttatccttatataatatatattgcaacaactatgagaagtgatacattaaccaatagttacaaagtaaagaagagtaagaagtgtttaaattaaactgcatgtccaccaccttattaagtttttatctcagcagagttcaagttggaattctaataaacaaaatatgaattttcatctgaatatgtctttgtctgttggaattcgaaattgtaggttgtgtcagcaaagtttgccctccctgaggacacaaaagaggcatcattgaaggctgatgaggagaagaacacagaagaagtttttgagactccaacaccagcaccaacaccagaaactgtcgtcactgagcaaaccaaggaggaaagtactgaggccccacaacctgcagcttcagaagacaagccctcggttgaagttgtgcctgaaactgtcacagaagagccaacagttgagaagacagaagaggaaactttgaagcaagaagctgctgtggaagcaaaagaaaatgctgatcctgctgaggttaagacaccagaagctgcagaagtagtgatagaaacacagaaagaagatgttgctaaggaagagaaagaagctgaggctgaagctaaggaagaggctaacacagaagccccggcagagaaaagtgaggaggtgaaagaagggtcagctgaaaagaaagacgaagaagtgattgcagaagcagaagctgagaagagtgaggaggtcacagtcacaggcacagaggctccaactgagaagactgagtaaagaatgtgaagaggggaaatgtgcagtttatgtgactgttttagttgcatcatgccataatgtgttgttgctccatgtcttttcttttctttgattagtgatctaataaaatgtctagctaggaatgagtgatgacccacttaagtttacgaatgccaaccatcagtacaaggaccacatggcatgtactatttcgatctgtttatgtactgtgagctctgatccaatgaattgaagtatgttatggtccttattgtgtgattctgcatgcagggtaactttctttgttcaaataaatatgtagattatttatatgatttgttcacgtcacttagtaactttgtgttccatgtcgttggccacctgcccgtactaaaaattggaatgaacctcggtcgcgggcatcatagtccatatagatatatgaatcaggttaagaagatacatccaatataatgaggtgcatctaatactggtttgcgagttttaccataaaactagatatggatctgttgtactggcgctttaaattattttcctgtaaatgtctctttcatagtagtaatggaatgcataaatgcgagattaaaagtagaggtaacaactactacttagtgactgccacttagggataaaaataaagcaggctgcaaagtgcaagtagatctccatcgattattatgacatgagggaaacatatgtaccttcacacaacattcaatgtaagatcaagacatgcaagtccttctcacatatatatgtttaatttatttttatctaatatgaatccgtctaatagtgaagagtttgaataattcacataatatgttagagatttaaattttattgttatcattgtacgcttaaaaaaatagtaaaaatagtatgaggcttcttcactctaacttactactcaaacacatttaggattaatttatttaaaagcatgttttgtaaccttagagcaaatttttttttcttaagcatatttttataggacaaccaaacatgactaattttactctcaaacatatttttggaactctcctaaccaaaattcaaacatattcaaacaagaggacttttaaatatgttgtatgtagggcctactgtcttttagacaacatatttataatgttatttacaccttcctttttgttcttcacagcttctctttttgtcattttcccaaaatacccttttttcttatcttcacaacttcacttttttttaatagattttacagaaattaattttcataataaaagtatgttctagtatatgattatagtttccaaaaatatttttttataataaattacaaatattattttggattcaggttcaatgcgttattgtatccctgtggatatttccctttctaaccatacagttgctagtagtctcactgtaattcccaataggggcgagcatgcaaagagcaaaataagagtagaaatagcatgagcctgccttgctttatctctttaaactgtatgggctgaggtgagtttagagtagtggcccaggaaaataacaatatcccttgctaagaatcttagaattaaaacataataaactaacaattattcttatcatacgggtattttttttaatttaaataaaactttaaaatgtggaattaaaaatttataaaaaaatgtatacaattaatttaaataaataaaaatgcaagtaatttttttcgataaaaaatacaaaatgcaagttatttattcttagcaaaaaaatcaattttaaatattattttaaagttaaataactgattgtttttaggtgtcttaacttcagtaactggtatttgaatattggatatgttcttccccatatatatgaacatgcaatttgagccagttgtctgtctctgtcatccaaaagctgaagcggatagagttgagttgagtttagtgctgtgctgtgttgtgtgcgtctttaatctatatagaatttggctttgtgagagaaaaatggtatcttaatttgttttggaactcagcaatggtaagaggaagagatgaaatgtatgtggcagcaatgcctcgaagggctacaaagggaccaccccagtaagctccctcagtttctgggatttccagcatttcatggtaacttatgttgataaaaatggcaagagtaacataataatataatatatgagatggatcgtaacataataacataatatgcaaacgcttagttcagatttgttttgtcaccgataaagtattgatgggtaacttatgttgataaaaatggcaagagttaaagagaccgttgagacaaaaatgagagatggattttgaaattggtttaattactttttttgtctatttttttctttcaatttagccctttattattaaaagattcaattagatcctttgaaataaattatcatgatattgatgcatcatatattcaataattttttttaagaagagtcttaactataagtactcaatcaagtagatcattttttttttcagtaaaaaaaaaatctaaatatattacaccttagttctaagatattctagtaaaatatattagtcaattataaggtaatccgtgagatattcaagtatcaaattctaagagtacaagtaaaagtcatttttctttgaaccccggccaaatcactcaagaaagaagaaaacttatagtcaatatcctcgatttccattattaaaggtgagaagatttatgagaattgttttcaatttgagtttaatttttatatatagttagtaccaaatattttacactggcaatcaattaaaaattataataaatataattttaaaataattattataaaaattatcaagcgtatcatataattaacttataattaaataatagtataaaagattacatgaactaatttctctgttagtttatcttaatggatgaagagctatacaacaacacaaaagtctaaataggcgagctatagggatatagtttagaaaaattaaagagtcagctcagctgctgactttccagtccttcaaatgcatttttaaagaattgatttgaaaattggatgtgacaaataagcattgccaacttagagaaattatagatgatcatcctatgcttatgaacacctagtgaaaaaaataaaagtgaaaaaagtataagttttatagataatgtggggagaaatgagaaatatttgttagatgaataaaaaacattgaacattcatgtatcatcactcgtaaacttgatagaaagggcttgttgaatatacaaagcatagatattaactcattctcacaaatattaatcgttatcgtaattagatggtgatttttttttctttctattttgtgtgaagtatcgtctgctatctaactttacacactagcttttcaatcctaaactatatgcatggaaaatactgcaattcttacgcaaacttttccatatggccaacaagataaaaatagtcaattctattttaggaggcgcacaccatacacacacgtgtgtgtatacatatagtggcggatttaggattctggatcagtgaggacaatttatttaaaaataaaaattgataactatcattattatatgagatagttggattcaaacacgaagataagaggaataaaatatgaagttttaagataaatatttgcattttattaaaataaaatggtacatttatttactcttacgtgtgaacgggtaaggaggttcaaataaataaaattaaggggttcaaaatataaaattatgaggtgcaaaatatgattatttttttgcattttattaaaataagatgatgtatttacttactcttatatgtaaactgataaagaggtttaaatacataaaattaaggatgtaaaatataaaattatgggatttaaaatataatattttaagacaaatactagtgatttattgaaatgagaagatgcatctgcccaccctcaaatgtatgtaggtccgctgtgtatatatatatatatatattttatatatatatatatatatatatatatatataattgattcttttaagataattgcagtcaacaatcgcgtcctgaaatgatcatgcagcagttttgaagaatgcagcctacccactattttataaagtttgtcatcaattattttatttcctggtgtgatatagagtaggtcgaaatttgcttaagtgatcaataatcaccatgtcctgttaataaaaaacaaactactatttagagagataaaaaaaacaaaaatcacggtattttttgttgaaagctaaaagccaaaaatattatgttttcaaacgtctgaagcaaaattttcgtaatgaaaaaccatgcctgtgactaaaaaaagtgacaacaaacattccggattaaaaaaaatagcaaacaaatcccccctccgtcagaaaaaaagagaaagagtcaaagaataatgttgaaatggcttctttattcaataaaaaaagaaaaaaaatatatgatatggatatccattatattatttaacacaagagaaaaaaaattatataataaaactattgatatcacaagaaaaaaaaaaagacaaaagtaaataaaaagattagatatatatttagaataatgagatgtttatatattgttattaaaaaataatataatgggtcggtagaggcataatccacctaacctccaattccattgtcaaagttggtatgcccaaatagctggaattgtaattggaatttgaatagaatacattacatgaagcaatgttgttgttgttgtataaaaaggggctttgtccatccatcaaccgcattaacagtaatacaataatacttattacttttccatactttgagaagctacgtacttacaatggctgctgctattgaaatccccacaatggtgtttccaaactcctcttcccaacagagggtgccagtggttggaatggggtctgcccctgacttcacatgcaagaaagacacaaaggaggctatcattgaggccgtgaaacagggttacagacactttgacactgctgctgcttatggctctgaacaggctctcggtgaagctctcaaagaagctatcgaccttggtctcgtctcccgccaagacctcttcgtcacctccaagctttgggtcactgataatcaacctcatcttgttgtctcagcattgcgcaaatcactcaagtgagcaacttcatttaagcacaattttttttttttttttttaccgataaatgttacttgttagtttattagtttttttattagtggagctgagattcgaagttcgaacccacgcctctcccccctttccttctttcttcaccactaaatcaaccttctaattccccacttgtaaagatttatatacaacttatgtttaacttataactctgtctgattcattttacttcaaatatatatatatcaatgcttttacttacatcaatttttgtcgtgcagaactcttcaacttgagtacttggacctgtatctcatccactggcccctgagttctcagccagggaagttctcatttccaattgaagtagaagatctcttgccttttgacgtgaagggtgtgtgggaagccatggaagagtgccagaaacttggcctcaccaaagccattggagtcagcaacttctctgtcaagaagcttcagaatctgctctctgttgctaccatccgccctgtggtcgatcaagtaagtctctctctctctctttttccgtgtgttgtattttgttttgtttatgggaatgattaatgataagattaattactactgttacaggtggagatgaaccttgcatggcaacagaagaagctaagagagttctgcaaagaaaatgggatagtgataactgcgttctctccactgaggaaaggtgcgagcaggggcccaaatgaagtgatggagaatgatgtgctgaaagagattgcagaggctcatggcaaatccatagctcaggtttgtctgagatggctgtatgaacaaggtgtgacattcgtgccaaagagctacgataaggggaggatgaaccaaaatttgcagatatttgattgggcattgacagaagaagatcatcacaaaatagatgaaatatatcagagccgtttaatcagtggacccaccaagccccaactcaatgatctttgggatgatgaaatataattaaactcctaaactactactactactacctcaaatgtttcatttgcctcggtttgcattttataattcatggcttcatgttcctttacattacaccttaatgagctttcttctagcaagtaataaaatgtgagaccatacaatacaacaattatagatttgtgaggtaacaataaggcactagtgaggtttttttttttttttttttaattcgtgagaataaaagacattgttactagatttataatatctcacacacttttatttaactaatcgctggacttttctcttccttgatttttctcttccttgatagaaagtatttattgtatattaagtatatttttattcaaataaatattaagaattaaacgaaggaactctaaaaactaaatcatatccttagtaaattgtgtgattttaattctattattacacaattatcattctattactatttaaatattttaacaataaactattataattggttgatattttcgtaattgtgaaaattaagaatataaaataatcaagaattagagatacaaacttgaaaaatataataattttttttccataatccgatgatccaaaccattcccaactttaataggattggaaaaacaaagtttcaaaacccaaatcaaagcaacgcaatccaatatgcatcattattttgtattcaatctcaccctaaacctaaattaattcaacccgtgaatattcctacaaaaatgagcacgaagaatttgaaatttgaaattctacagttttaggtaattaaaatacttccacaaattactagaatttcaaatattttttaaatataatatccaaacaacatattttaattataaaattctctcttacgttgaattgctcatttaaattttcttatccaaacataccataaaatttacaattttgactgttctaaaataaagaaaagcaaagtaaacaattttaccaattaatgagtaatgtttcaacacatgcaaaatttgttatacatgtatatataatattaattattgattttctcattaattaccaaaactactcattttatcttcttacatgaattgctcattttaaataaactaaactcaaaattatttatattattttctaaaataagttactcaatttaaataaaccgtatctgaaagtttaatgatgatcagttcttcttaaaaagaaagtgaaagatatacttaaggtaagtctctggatcttagacagatttatgttttcaaaccatagatatggttttgatttttattttgggtatattttgacccgaaatgtctacatgcactgaacttttatgggttcactcaatcagtaaaacgtaagtccataggtcttattagatagctttatgttttcaaaccatggatatggatgtgcttttaatttttattttaggtatatgttgacccgaaatgtatacttttcacgggttgactcaattactagaacagtatattaatttggataaatattagagacaacttatattttattttaatataatagacttaaaagcgcacattcaagtgtaggtgtctttgagattaattatcgcatcggaaaaaaatattttttttatataaatttataataacatatagattttttttaaaataacataaatacaatttttttcataaaacataacatatataacaaaaaaagtattctgaaaacataatgaatacagtttttgacaatcaatcaccttcaatgaattttattaaattttacaaaattatctatgcactagcatgttgatattaagttttaaaataacatataaatcctacttttaattttatttgcaaataaataattttaaattttatttcacaattatgtcaaaatattttttctcctaatatatttaaatatatgtattttaattttaaaattaaatacctctattaagtgtaaaaatagatatatactgtatattttataaatatacatataaaaatgaaatttataaataatataatattaagaaaagaagaaaggtaaataaataaatttatttataagtagacatgtatgagttagttgggttaagtagtaagaaaaggttaaagagtgtcacatcaaaatatcaccatcaacaccaccacgagtccacgacgttatgcaagaaaccaactaccacgatcatgagttgacttgggctacaatgaatgttataaaatccggtttagctctgttggtcgggtccaactaatcagaatctaataacctaacttgatcagttttactattgaatgttcatgcatttaagtcaggataacccgaccaaatcagacccattttgaaaaaatctggcaatccgactgattctacaaacccggaccgggttatgcaaaaaaaaaaaaaaaaaaatggaccatccacgccaccatcttccccgacttcgacgcttcccacctcttcaacctccacccctccgatgccacccgcctcaccctcttccccgccgatctcctcgacgccgccgccctctcctgctccatctccgcctgctccggcgtcttccacgtggcctccccctgcaccctcaaggaccccacagaccccctaagagaccttctcgaacccgtggttcagggcaccctgaacgtcccaaagcggcggttggcatgcgaagatggtggcgatggcgctgatcatggaggcggcgaggaaggagaagccgaactcagcggagttttggaagaggatcatgacgacgtcgcccttgtggattccgaggttggacaatccagcggcaattttgcgggaaataaggtgcgtctcggcgtagtgaaggttttggcggcgggtccaacgatgaggcatgggcggtcggcgaattcagagacgttctcgaagcagtagacgtggagagggaggtggttggagattggtatatctagtaattttgatttgaagacatggctagtttgggaatcacaaactttgttttgatcagtttttggggtagacacctctttggcatcaagagaaggagctacagttatcatggtgtcatatataattttaatttttttaatatatatcaaataaaattagagtaattattagtttacttattggatcattgatacaataatttattatcttgacctaatcaataatggaactgaatttcataatacttactatacttatcacatgatttttcaagtttgactttagttaatgttatttgaatacatgttatattagtatggtgtattatgagtaatgtaagataatatattagaaccagctcccattttttaattgtgtatttaacatgaaagataggatcaaactaattttacatgggatgattttattcaaataggataaaattatacgtgtgacaaaattctttcttttaaatatataacataacctatcattaattaagttaaaataattatgagttgatccacaattttggtaattacatttgaaggtttaaataaataaacatagcctaccaagaagaagggttgactatttcatcctcagaaatagtaattaatagtatagtttggctttgttgtctttgcctccttaacagatgatgagtcatgagtgacagatacgccgccggactggacttggagttttgttttgattccttctcacatggatggcactcacttgacctgttcagtccaagatttttcgttgaaaggcatgggctaagagctagctcacaaccacgataaatcattaatcatagcccaaaaaattaaacgctttaatttcaataaaagacaatttttcaacagcttaaaaagaagtttgagcgaagttttttaaataatgggtcttgttaataagtatttttaaaatattaattaagatattaaaaaaataaattatttattatataaattataagataacgtaaaaaagattttagatatcataatttttatttttgataaaaatatttttactttaaattttttaatcaatatatttaaaatactgattaacatttttcttaaataatagagatttcagggagctattattttatctcgtccattattattggagttaatcttagtcagctatcatgatgttaaccttctgtccatttatacatagctcattttaaggattctacttttccatctaatattattgtcatcatgtttatgtgcagctggatttattgcttagtttcagatatgtaagttttattctaaacgaattaatggagtcatgcaaattattcaaaattttgaaacgggtgtcttttgtgtcttttattatcatttcactggcagcggtcccttatttgttactacatagctagaaatcaaaacttttcaaaaaaaacgaaaagatgattgaataagtcagaggaacatatgttattcatctatcaaagaattaattaaaatgaaagctcattatagcaaaatttgtttaccctgcctaatactttcctatccactgaaatggcaaatctaaagagtcgacgcattatatttacaggaataaaaaaattaaataataagagtatgttttaacctataaaaatattattataataactttcaatttttttatctttttccttcctcacatcacatgtgtcgaaacaatgttgctcatgcatatagcaacaaatggctaatcaattgttgggaaaacaaatctttcggacatgaaacccaagttggtaacgaaaccttttttgtcaagtagttttcacctgtaatttgcccgcggtcaacaagaaacgtaaggaattaagaaaatgatagacatccatccgaatttgcatgtccaaaaaaagagtcaaataattatgtagaaaaggcttctctagagtccaattattttcaaaataatcaaatacgaacattttagtatgaggatccgtgataaatattttttataaattaaattttataataaatacgtccgtactactatatatgtagtatactttaggtttacaatgaataatttaaattctgaatctgatataagaatttttttaattattaatattttttaaaaatttattaaaatgcaattaagacttgaaagagataagcatgaaagattcggccaagaaaagttcacggatcagttgacgacttgacgtacgtacttgatgacaaaggttaaagtttatattattatatgttaagcgagtttcaacaaccaagaaggtgtcgtaggggaaaaaatattacatgattgaaaatagggtgtgaatttggatatgtaaatggagatgttggcggggacggtcatatatgaaatcttgcatatgaaagatttttcccccatggggatggggatcagataaatattctctcgtgactacggtgggggatgggatcacacctccgttttaagaaaattaaataattatttttatattaattattattttatattttaaataataaaatattaaagattgattttatattttacttgtattagaatttaaaattaatgttttaaattgttggtgaaacttttgagtattttttaaatttacttgtattaaaatttaaagttaatattttttaaaagttcagattcttcgaggactgtgaagatctatagagacggagacaggaaaaaaaaatctccaagatggagatcggggatgggatgggagtagggagtattccccgtccctaccctgtttcgttgagatccctaattgaaaactattataatttcaaataatcattacatatagttaaatattattaatttgccaataaaatgagaaacaaattcttttatatctcataatataagacatccttaagttcatatgtattgaaataatttatttagcgagagaatctgtatttaattatgtattttatatgttcataatttgattttcaaaatagtgtaaagtgttttgaatcagattcggacctattcttcatctcatgtgtaaaatttctttggatcatcaagagtcatgcatagcaaataaaattagtttttaacttaataaattaggaaaaatttgtgatacctaacccaagaaaaaatatatatctcttaatgatataaatttgatttcgattacccatatacaaattttgttagtaaaaaatctaaaaaatatttgtataaatattcatttaaccttaagatcgaaccctaataaatctcatataccaactcacctcaacttttaatgataattttaagtgtgtcccagagaaattgattaaaacaacaagcgatgctccgaaagtatctaatgagccacctcgatctcatctgaccaagcttcctggttagtacctttgaattgaataatataaaaaaagaacatgatggatgggggtagagctcagtataacccacctacctccaattgctgacttttcaaagctagactgcccaaacccaaacaattggaattacatgaagaaatgttgcactataaaaaggggtgcccttcagctatgtccatcaacaaatattggaatactactcttgcattgcatactacactatacttgttaaccctttgagagttacaatggctgctgctattgaaatccccacaatagtgtttccaaactcctcttcccaacagagggtgccagtggttggaatgggatctgcccctgacttcacatgcaagaaagacacaaaggaggctatcattgaggccgtgaaacagggttacagacactttgacactgctgctgcttatggctctgaacaggctctcggtgaagctctcaaggaagctatcgatcttggcctcgtctcccgccaagacctctttgtcacttccaagctttgggtcaccgaaaatcatcctcatcttgtcgtcccagctttgcgcaaatcacttaagtgagcattttttcacacaaaaactagttataattcataattaaacttcttttatgagtttgtgcatctttgattttacctttgataattaattctaagtaaaaaattaattttaaatatgattttacatgtttaatattccgttagagaaaagttcaaaattgattatgaattaagcaattttaagtaatatttgcattagatccaaaaatttcgctaaatttaactcctaatttgattttataataaaaatatttgaacataaatcatatcatttcaaaatcaatttcattcaaaattttgtcaacgtttcaaacaagtttattctgacttctataaatgctctcttgtaaaagtttatatacatatataacttaattatatgctataactctgtctgattcattttacttcaaatatgtatatcaatgcttttacttaacatcaatttttgtcgtgcagaactcttcaactagagtacttggacctgtatctcatccactggcccctgagttctcagccagggaagttctcatttccaattgaagtagaagatctcttgccttttgacgtgaagggtgtgtgggaagccatggaagagtgccagaaacttggcctcaccaaagccattggagtcagcaacttctctgtcaagaagcttcagaatcttctctctgttgctaccatccgtcctgtggtcgatcaagtaagtctctctctctctctctctctctctctctctctctctctctgtatgttgtactttgttttgtttatgggaatgattaatgataagattaattaatactgttacaggtagagatgaaccttgcatggcaacagaagaagctaagagagttctgcaaagaaaatgggatagtgataactgcgttctctccactgaggaaaggtgcgagcaggggcccaaatgaagtgatggagaatgatgtgctgaaggagattgcagaggctcatgggaaatccatagcccaggttagtctgagatggttgtacgaacaaggtgtgacatttgtgccaaagagctacgataaggagaggatgaaccagaatctgcagatctttgactgggcattgacagaagaagatcatcagaaaataagtcaaatcagccagagccgtttgatcagcggacccaccaaaccccaactcagtgatctctgggatgatgaaatataaactatttactatgcagctcggagtctatttttataatccatgtttctttctttttaccaacccagctctgtctacttgtttgatttgaggtttaaataattgatgcgatgtcacttcttattttagtatttcgcaccacttcttttccccttttactcaagcccacctgcattgactatttattaatgacccatctttcgtcttcgatttgacgaggttattacttacaccttgaaaagaacactataaatcatcaaatttaatgaagcatatcatgcaaggattgcaatctaaatctagcctaactaacagaatcgtacgtcgcgtgtttgtagctccaataagccaaactgtaccacatacaaggaataaactagggacgtgctgcacatgatatgaataacctatgtttcatttttttcttaatacttctatttatgtgaagaaaagaattttgacaaatattaaattccgttgaaaaataaattaaatatgataaaaatttattttcgtaaaaaatcaaatcaaaatattattcaaacgatttaatttcaatttcaatatattaatcacttatttaacccatttgtaattttatcttaagaaagtttgattacagtgacaaatacttgggaagtcaaatttcttttaaccaattaaaagtaaataattactactagatgatagtgaaacatgattttacactaacattaagttaaatttatattaatctaattatacaatctatacactttcctgcaagtttctgtggtaaaggcccagtcttcaaattttgcgataaggtatgaccaattattaaaaggagtggttgatcagctctactatttctagtgtcgttttatcaataaaaaattcagtcaatcttgtttgttaagaatcggctacaccatttacaccatatatattagtatttgtttttaaaattcaacatattaagctatatgttttcttaaatacattctcttaattggtgaaattaaacagaaaaaactagtaaaagggcgagtgaaagagattgccaacgaaattaatgacaagttataaaaataaaaatcatgtaaattccacatatatgtttttagagttttatactcacgcacgtgccttcgtttccttgtttctttttatctagctaccacaaaaagccatgactactctggatcacctttagatagtctattatggaccacatttaataatcgttagattcatctcaggtttatattgataccatgcattttacacactagatccattctttcctccctctacagtccctctttgtcgtatatgttactggagaaggcgatttccagcgcagcagcgacgattttcttttttatttttaaaatcaacttcttccttttcttcctagattcaccggaatcctcatctctctgcatagttcttgcaaactttcctttctcaagagaggttaatggaaaccattgagtattaacaaacaacttggaatattgcggtcaagagtggctctgatcactgcatacaaacttatagaaacaatttgaggattgaaaacaatttctcacactttcttggccggaatcctcatctccgctgtccacgagattcgcaacatgcggtgcttgtggcggcacaccaaaacctccttccagtggctcctttgcttcttccttgcatctgagaaaaagttccaggcacggggcgtagatttacttccaactctagttccactgcgtgttgcggatctcggtggcagcaaagatgaggaaggtgacgccggcgcacggcggagaaggtctgcagagggatcggaggtgagaacaaatctagtgtgcaacatacatggtatcaatataaatcttagatgacctaacaagaaaacctaacttcaagcattttaagtttgagaactgttctcagcttctaatcgtgacaataataaacaccaactacataatcatagttattaataattgagttataaaattaatatcaatcatttatgaataattatatgattaaaaattatcattttatcatttttatgataataagtaaaaataatttccatttaatatgtccatataatataaacaattagatgattttttttttcattcaacatttaatacataactcaaatctttcagcattcattttctttttgtgacatcttgatcttttttttctccctaaaagaataaacaaaaataacaaaattacaaaaacgaacgaaatgaataaaatagaaatttacaatcagaaatataatataaaaacaaaaataacaatacaaaaaattcaaaaaaacaattaatgttatgtctccctccatccctatttagaaaatcattttaactaatttgcatcccttaaaaaataattaatttaataaatcatattaaatctgtaaattaattatattatcattctaaaattatcttttcttatctctctatttgcttaattatttctcgtttatatttaaagaaaataatcaaataaaaatatgtaaaaaaattaatatatccaaaaattacaaatatatataatcttataaaaaaagataaatgaatttaaaaaagaatattagaaattaaagaccagatataatatatatctccaaatcccattctctccttagagttttctacttgttctccaaatttcacagttttgtaggcaccatatccctgagtcacctaatcattcttaaccttacccctccacgtgacacctattgccttgtccgtggtctctgcgtgagaacaaattggctcagcaccattacaccaccaccgaagccaagggatatattttgaagtaaatggtgtttcaaggagctatcattttaacaacttgtccatttattattggacaatattcagtgagtgagctatatatcatattaaccctctgtagactgacttgagacttccacgaattgattcgcatatgatatgaacttggacagtgttaaagttcagaatgaatacccataacaaataatagaaacgtacaataattaatcattaaaattttaataaggtacaacatattaagagatttaactcaattaattattaatatttatctttaattcttatatattaaaacaataatgttcataatattgcctcaagtctcaactcaattcaatatctcatgttctttttgaagatatacttttttcaacatttatgaattagtgataaaactttacttaataaataatatgatataacattatactatacttatatatatatatatataaataaataaatcataaaatatatttaataagatttaacaatacataacttaattgtatattttatgacttaattatcatcatgttacaaatttttcttttttacaaattttatcattcaagtttttaattttatgtattttagtattcaagtttgtttttcgtatattttaccatttaaattttttatttttatgtattttattattatattaataacaaaacgacattatttttaaaaaaattgatctttttagtgacatcatcatttacaaactatacaaattaaaaaaattcagtgaataaaataataaaaattgaatgataaaatatgcaaataatcccaatgttgcccaatatattatcaagcttcaatcaggtcaaaattatatactacaactaattgatcctcaaattcaaaccgaacaaagacaaagataatcgctgaatataaaaaaaaatgacaagattagccaataccacaaacgcccctaatgtaatgtaatttgtaatgcattatggtataattttataattcaagatagcgaacaatactcgaccatatttgacttgtgtcaagattttcctttaaaagtggcacgcaagttgaaatttagaatatccaattcccaatttattcaatttcaaaactcagttcccttttatcaagtaatgtagaaattcagttaactacaacaacaacaaatccttatcccatacttatcaggcaaaattaatgaatgttttttagcggcatctcatacttttcatacaagaccaagatacaaaaaaaaaaaaaaaaaataacagccacaaatctcacgaatcatatgcagatctaaatcctgccttgcaaacaaatagaagttctattctatttgacttcgtatgacagtaaatggtagattgtggaattacgtagcaatctctgagagatagctggtaaaaagatacactgcatcctgcaagtgaacagagcgttggtcttctggaatgggagcactgaaagaagtgtcaaagcagttaaactgctcatcacgggtagcaccatcacctacacctgatagtagcaaatcacatatctcgcctgccattcttgaatacaccaccctgcaaaatcagtaataaccgtgaatatggcaaatgaaacttctctaaacgggtgacccatcacatagtaaatatggccaactaatgaaataacatgtcaaaaacatacaggtgcttaaattattgggataaagacgtgtggttttgatgtagtaaacaaactgcaaaaccagattcaataacactagcaactaaactaatatattactgtattatcaaattttctttgcctctttataagtccgctgccagataaaaaatggttttggataagtatattagcaggcctataaaatcagaaatcgagctgcacaacctaaaaacaggtcaacaagaagttactgcaaaggacaacacataccttgcatcaacaggtaatctgcaaccccaaacagctagggattcatttagctgactgacaaaatcctgacaagcagcatttttactttcaagagaatcctgaaacaagaaattacatgattttaattgatcaatcaaatggaaaaaggagtattcccttaatctctaacaattgaaatcacaacgaagagtatccactctactgatctagcaaacaaacactgcaactgttacctagcttcataaatcatatttttaagtctattaaaagattatctcatggaaagattgcaccagctagaagcatttcaaataattgggtaacaggcattattgtcttttgcaccactgcatgtgtgtgtggttgtgcccccaaaatatcatcatattttgtgataaatttgtaacatgacaattccatgtttcaagcaggatcaaacttgtttaatatttagttacacttcacaatcatactatgacaggatcaagtaacaaccatttttcacataaatgatgatatgagggatgatcctcttctataaattcacgtaccaattcagtcatagcattggtatcatccggaagtgagtttctcatcaaataaaatgaaatataaatatcagctcccaactcccagttttcaatttcagatttatggtcctccatggaagttgctatcctccatatctcagcgtgttttgctgccaaagatattaaataagttatctatgatgcacttatctggaattaagaagaaaaaatctagtaattttcttctattgaaaagaaataagttgtgataaaatgactttcagcaatttaaagtaatgatgatacaggacaaaatggggtgtgggggggtcaacaatattttattgaattttcatgtagttgttgaagagtttttcttttgtgatttactgggttattttagattatttcatcgtaattatgatgaaattaaggccctgttaggatactatatgaataatgaaggttcttgaagatttttttataaatgtccataaaagagcaagcttgcatgagagacgcaggtattttctggcaaatattattcggtactccaacgttttccttattttttggttttccatagttatgactttggcaaatattattcggtactccaacgttttccttattttttggttttccatagttatgactttggcaaatattattcggtactccaaggtgttttttaccaagcaatatacacacacgacttaccttgcaagaataacctatgagcaactgaagttataaaaatagcatgagctttctgccaatttgcacactgaagaaattgctcaagggcttttgagtgatccccattataattataataaattgcctgcaccgccacaacaaaatcattcaaacaacaataagagtcatttaaagaaaaatacaaaactttgcaacatttcaagcattaatatagcccattaatcagtaaagaacaccaggacaacaatttaattcagttttagacataaattgatcataatgtgtgcccatatgaatctaataagcggtttttgtccttaaaaaaaaacaaatctcataggttttataactcaagcaaattgaaaaaaaatcatttatataaactgaattaatagtataatcagaatatacagtgtgcttgtatttttttttcttttttcattaatggaacaagagggatgtactagaaagtaaagggaagggaatggaacaaagctatcattatgcttatttggaagattaatataggaacagatagaactccgataccctttgagttccccccactccaccctaattttaggggacaaaatttgtgatatggaggggaaatgatggggaatggtcccctgatgttctgttccactccaatctgtttttaaactcccacaaacaagggaacttattgtccttcccctgattccctctccattcctctcattatctatcatccaaacatagtatgagagaaagatgaagttaaaagggtactgcaacaaattatgaatgccattgatatttttctttttacaaaaaaatgaataaaaaattaaaaaatatgatgcataccaaagcctcatgcatccaatctgtgggaatgcctaaatcctcaatgaactgttgctgagattcatctgaactccaagtttcacagtattggaacaatatttcccgaatcagatttacatgaagatatggataatcttcacgaaggggcaagtgaaggaccacatatagggcccaatgacatttccctacacacaaaagctgagacacaaatgacatatctagaatatgaagatcattagaattgataacacccacagcttccaagactgctcgttgatgccaaatcatatgataatcaagtggatcaggggtagaagagaatgcactaaacatagccttcagaaagctgaattttgtctctttgctggcatgaagaagcattaaataaaatgaaatgtcaaagtggttatccgtgttccaactgataacctcctctgatgttccttcatcaataaaaaggggaataggatatggagctgttccctcatcaacaaaatgtttataagtctgaaaagcaatggctaatgaagtgtttggtggtaatttgtaccacattaataaacctaagaacctcctccagtcaattttgatgtcatgcaatgcatcatgaatatttcctgcaagcaattcatagagtctcaatctgtccttttcaatgaaactaaaatccagccctttatttctccaaatatcaagttgccttgcaatatcagagcgattcacagtagaaccaccagcctgacttaacaaactagccaacctcacatctcctttggacaaagccagctgcactgcttcatctagttgccgcccagtcaggagtacaaatatatgctgcagataatcagaatcatttagagagcttatttgattttgaacatgataggaaacactctctcgcaaccaataactaaactctgccctcctcattagagggagtgcttctcggtcaacatcttgataaatttcctttaaatcctgcatcatatcttcctcattgtcagcacccaaagattctacttgacctttttgttctctgtcagaaaaaagaactctaattaactcccaggtcattacttggtgtgtcaaacccaaacgagtagtggaagataacccaggaacactcaattgccgctcaataagatcacaatagtgatgagaaatctcagatagagtcgaacgattagcttcaagcttttgaagtgtcaacttgcagggaccaatttcaacttctttcatcacatggtttattcctttgtgaaaatttaatggagataccaaagcatgatcaacaagttcctcggtcacttttttattttcatccctaaccacattgtcgaaagaaactttctccaaattgacaacagatgataacagtttgtgattaccactgcttcctacgggtgcaccggagtgtacaagaatgccatttggtccccacccaactcgaaatgacttacccataaacagaccagcatcaactatattgtgggcatagtttccagatactggagtttcatgtttgagatctagcttaaaaccttgtgattttatcgtcctaagaggcatgcccttatgctgctgaaccatcaaaatgcctccaggagaatttgaatcaaaattcccatgtttatactcaagtaatggaaatggagtttttctagcaactggtggggtggatcgatggttgattgcctgagttgaactttgtaaaggccgcacatactgcttaccagaagatgatttgcagcttaagtcctctatctcttcttcatcaggaaacatcaataatctcatttctctcattttaacaggatcaagcctaagatgagaaggaagagaatgagaaagttcaagttcattggtatttgatggtgattctttctcaacatcatatacctcagcatcatccataacaaagtcttcctcatcatcatcaccaaacccaaacctgctgaagtgtccaactaagaatttccactcaccagtcactagatcaaaggaaataaatcgtgcttcctgcctctttgtaatttgttttaatttgctaactataacatcttccttcccctccttagacttcaatatttcactgtctaataccaaaactacttcagctgccttgttaaggccctggccaacagcaggcttatcattttcatcactgtatacaactatctcatgcctatgaaacttcacaatttcatctatacgtaaccccctgacatcagtttcattgagatacctgacatatccataaccaaatcttccaacagtgaaatcaggaacacggctgcaataaccaggttcaacaagctccctggccactaattccttcaaagatggtttggtgtaataaccggacgagttcaagataggtagggaagcttcagtttctgtcatgatatcaatggatggatgaaaacagcctttataaacccttcttctcttgcaagtgtgcaaaatgcatgaatcagagacacctccaacgtcacattccatcacaaagctaggtcaaagtgaagcgttgcgttctgcacattgaaatttgaccgcaattccttgatgtagtctctaaaacagaaaaataaaaataaaaaataagcgcatatgccagcaaggggaactggatgttgcatcttatcgcatggaaacaccacgaaacaagcaaatgataggaatatacaggtttcaatttacctcttaggttaacttaaaataaaacgatagaagataaaagaaaagaaaatatgcaatatagctagactacacaacagaggtatttatttataatgaataaatatgagtttgagaatatgaaaactaaagatgatttgattaagcagttatacagatcaagcttactgaaagtgcggcatagcatgtagaagcgtagaaataaaacgaaaagaaaaaccaaatacatagagttaagtagcgtcttagtgcgtaaaaaagaagaacaaaagaaatgaagtaggctgaagttggaatacttaagatgaactcacatcaaaggtggagcagcaagcaacgacgctggagcgagcgaggacggtgagagtgagactgtgagagacggagtggtttagcgggatttgggaaggacaactgaagttgggccgagttttaatactacaacaaagacgggcaaatctacaatgggtatttagtatttacactttccatattgttatttctactccccattggcttctttttttttcttaaaatatatattactaagaagtaagaatatatcttttttatttatttataaaaggtataaactctatttttgaaatatttctgaaagttaatggttaagaatagatataatcaataatatatcatcccaaaacaaatgaattcttcaataatcttgggcctgtcttaaatgatagggattgcttctatgttcactgtcccgaaaagtagaggtatctgtttgaggttcttcaaacgacaatccaaacacacgattaatctcttcgtcaaacacatctttacaacatgtagatatttcaaaacaagctctgaatatttaaatagtacatactaagtactacatttgatctttagatataattgttcatgtgtccttacaaatagaattaccccggacataaagacatgttgggctgtattgggccaaggcccatgaattcccccgctaaagggagggttcttcttcttcttcatatttttcttttttccttaaaaccctcttctctgcttgctgcttgctgctgctgcctcttttggttgagttgcgtcgtctctctaacaaaacaaacaaaataaaaatgatttctgcgatttcgtgggtgcccaaaggggtttcgaagtcggaacttgtcgtggctgaacctcctcccgaagaagaaattcaagggataatcgccaaccacgcaaccaaaaggtggtccttttgtttggttccaacaaaaattatcattcaccagtaaaaccctaacatccaatttttttttatgtgcagtggagacagtgacaatgaagacgctaacaacgatgaagttgtggcacaagcattaaccgtagcagatgcagtcggcaaggccacctctggaacctgtgacgaaataacccttgcgttgaaggaccttgatatggaccgttatgatgacgaagatgaaggtacgtaattctgcattctatatgatcattcattgcttgtacttatatgtatgcaatgcagcagctgcttaaacttacgtttgtcatttgtttaggaattgaggtgttcagttctggaattggtgatctttattatcccagtaacgacatggatccctatctcaaagataaaagcgtaagttccagctcttgttgtcattttattagcgttgcggttgcggcgcgtgtcttcttattatcttacgttgtttatgatgcttcaggatgatgattctgaagaactcgaagacatgatcattaacccaactgattctgtcgttgtttatgcatgtaccgaggatgaagtcagttatcttgaggttagtgagttagttgttttgtgacttgtcaagtcctcgtatattatacagatatatacttatcactcctttctttctgcaatgccaggtttgggttatcgaggatgccgattctagtgaaatgaacgtgtatcctcaccataatatcattattccagcatttccactctgcacagcttggctcgattgcccccttaaaggaggagaaagaggttctttgcacgatacctcttgcgtgtgtatttgtgttgatcgagttgcttgattgtttgttttgtgcaattcgacttttctccctccccagcactcaccatttaattgaattgaagggcgctcctagaaaagtgaaaaataacaagtctgaaggaaaacttgtaaactgtctttaattatatcctctgattatttctgccttcattttagtatgccaaaaatgaaaaatatgaacaattcatatatcatccaaaggtgaagtggaaaaattgtaatggaaagttgcatttcattagaaaataaagtgagattagtatatgctgttcacttctgttgtgtagaccattaaaaaaattcttcaaagtttgagtaactgtctaggtttggactacctgaaatcaccaccattgcaatttgtgtttaaaattttacttgatacctacttgatatatctttgctttatcttattagcttaaaataattttattatgatcacagggaacttcatagctgttggttcaatggaaccttccatagaaatttgggaccttgatgttgtaagtggtttgagtatataaattttaactgtgttgtctgaaatttcatatacaaaaagagagatctttttttctgaataccttgtaattttcctttgctctcagattgatgaggtgcagccatgtgtggttttgggtggatttgaagagaaaaagaaaaaggggaaaaaggtttgttctacatttttgttaatttcaatccccttagaatcatgtgattacctcaaaatggcagcatacttaattatgatttatttgtggaaattgcatatgttgtgctgtttgtaaggtttgtttgtgctctttgaaaatttaaatgcagttaagttgcaaattattgttgataattcaagtattattgtacatgtgcaggtatatatatgcatgtgcacttaaattgatacccttagcttagctttttacttatgaaacttaatcattcatgtatatccatgtacatttttgtccattgttagcattctgactcaataaaatgatagaaacctagtatatcttgttagaaaaaaaatagggaaaatctcccctggttacagcactgcagaactttgatggtgtgcacctcccaatgccaaaaggccctaatttcctctcacaatggcaggatgccttcctttgctctcttcagttgtacatgtgaattcacttcaatgatcgtagctaactaactactaatatatgggttagttgatctcttactacaaaagatagtgaaaatctcccctggttagttactgcattgcagaacttcgagggtccgtgataagcgtaagccacccatcactagggtgtatacttgcaagcagcgagtaatagaagcaacagttctggaccacccaagcagtgctgaccacccaacagacacgatccatccaaggggcgcaaggtcaagcgatgcgaatcaaggggacatgacctttggtgatcacccaacagacacgatccacccaagggacgcaaggtcaagagatgtgaatcaaggggacatgaccattggtgaagagacacaccctttgggaccaggaagtgtgactcagaagggtgcaaccggtggagaaagagtgcaacccttggagccaaaacaacatcagatctggagcagttacaaatgagaacagtcacaaccatttctgaacaattgtgtctattaggaatagatgttagatgcagtataaatagaagtaaaccagattaggaaggggaggaaaaaacaaagaaggatcagtctgaattgtggagaagcaggctctcgaaaacctgtgttattagaaaatatctcaatttacttatataaaatttctattttatcttttctattctacaccatcttctctgttcttatcagtccgcaccacccaatgccaaaaggccctagtttcctctcacaaatggcaccctttcctctcatctgttctaagtgatacccttcactgattgcaactaactaataaataactactaaccaactaattaaactaactgatggcttagctaacaaaactcaactaactaatggtttatctaacataattgagtatatcttttggtcttttctgaattttgtaacttttttatttgggattgtgaatagctttagatgaaaccgaaattgcagatgtcttatgcatatgagcattgaagctactagtgtgaaaatccatatttttgcttgtactattttattagactttcatctttatttttttttaatacttatagatttttgaagtaaatatgtttggccatttcttattaaaattattttcttgcagaaatcaatcaaatacaaagatgacagtcacactgactcagtcctgggtcttgcttggaacaaggagtacaggtttgttgaattaaaactggattctgcttttattttctctgttggatgtgctttctggaacctaaaagtttatcttgacttttattttcttaaaaaaaggaacatactagcaagtgctagtgctgataagcaagtgaagatttgggatgtagttgctgggaagtgtgatattacaatggagcatcactcggacaaggcaagaaattagctagagcataatttattttttatcatgaggtcaattcattttattgatgaaaccaacttttttctcttcatgttgacacacttccttagaattattatataatttagaactttggagatatgatttaaaacatcaaatagattgaggtgatttttgctgcactattatgaaccaagatggaacagttatgtaattaatcatttaatcttcagctttgaattaaatgctttattcaatctatatgtatgtgagaaacgaatttacaagtctttcttgggtctttgttgagcaatgctccacatttttttataatggaaaaagtttctccttctttggttgaatgatttgacgcaatgttttttttttttttttttttttttttaattttctgtttctactttaaaatatttgagtcaatacatttcctgatgtctttcagatttatctcttgtccatctattctcacaggttcaagcagttgcttggaatcttcatgcaccacaggttcttcttagtggttcatttgatcatactgtcgtcttggtaatgatctgatccaatattcctttgttactcggcttttctgtattttgctgtcattgattacttattatgccgtacactttggttgtatattgatgtgctaaaagaggcattcaaattaaaaaaattgtttattttttgtttaaaaattcatatagttatctaatatttatagcttttacactttgcagaaggatggaaggatgccatcacattctggctacaagtggtcagtcacagctgatgtagagagcttggcatgggatccgcacactgagcactcttttgtggtgtgttatagttatttctaggacctgagtactaacatttcttttcttttctttacatttttttgataaaacatactagcacttttttatgataaaataataaccaacattccttcagctactaacttttttatgacaaaataataaccaattcttattctgtaagatcaaatttcaattttgatttcgtggatgcacaggtattggttcactaatagtgatttaattgttctgttaggtgagtcttgaagatggtattgtcaagggttttgatatacggactgccaagtgtgattcctcatcagatccgagttctacatttacacttcatgcacatgacaaagctgttacctcagtatcctataatccatcggcacccaatgtatgtatcttcaacagtttggttagaatatcaactgattatatattttagtttaacctgtgccctgttgacatgacttcatgcagcttcttgccactggatccatggacaaaacggtaatagtgaagtcaattttgttatttttcggtatactgtactttgcagattggaattcatctcatttggctgctattatttctcacaggtaaaactttgggatttgttgaacaacagaccctcttgtgtagcatctaaatctccgagagcagtacgtttccttctttttttattttttaaatgggaaagcttcaacgaatcataatatatttgttaaattggcactgatgactggtatcttttttatggtgtttgtttgttagggggctatctttaaaatttctttctctgaggacaaccccttcttgttggctataggaggctcaaagggtaaattgcaagtaagtgaaaagtgcagatgaacaatactttcgttttcttgatcgttctctgattcttggtgtgaaattgacttgactgttgtaacttgttataatttgtaggtatgggacaccttatctgattctggcatctctagaagatacgggaactacaagaatagatcgcaatctgggtcttgatataattgagttgtgctgctgaagttgtgttgcataaatcaaaattttgggattcactgcaaaaatgcttttttttttttttttgcatcctaataaccttatttgaaataacagatttgaatgggttgaacataaattgttttatgtgattcaaacactatatagttttttactttttagtttggacatctttttggggacaaaacccaaaccactaattaagaaataaatggttgagatgataacgaaaattacgaatactaacatctaacattttttgataaaaaaaactgtaaactttattgtatatttatttaattttatcagttttaaatcaatggttttctaataaaaaattgagtgtatttatgttctatatctccattattttagaagcacaaaatccttaatacatatatacgaaaatatactcttgaatatttcacataactataaatatccgaacctttcgaaataactatgaacctaataatactatagacaagagactagaagcaagtaggaacgaaaatagactaggtcaagttacgctttgttagatctaagctttagcatgtttacgtctcaaatgactttttaaaaggcatgtcttaacatacataaaagtttgacatgatttataagcgtggttgatcaaacaatgaatgaagcctaaagaaagagttttagttattttatttttgggtcgctctttctttcttataagtatgtttaaaagtttattttataataatttaaccttgtgatagaggtgaaaataggaacttgagactttgtaagaatgaagttttacttgtttatatgatatgaacatatttttaaagtctaatataacattcatatgataactcatttaaaaatatattttacagtaaaacccctaaaaatgactaaacttatctttcaataaatcttaaattattcattttttaataaaccaaaaataaagtttatctttcatgatgcttaaaacgggaataagattgatactgtattaatgataatgatttatattttttatttatggtaatttttagaaagtatacttttaatttggatttgttgtaattatatatttattatgattaatgaatttctgcacatatttacgcataacgtattttatatattttgagaatagtcaatttgctttatcaaaaatatactatatctatgtcctttttttttttttggtagtgaatatatactatatctgatatgtgtatgatatttgtgtatcatctctaattaatatgtattgcagtataaaaataataattaatatgtattgtatttgatatgcgtttcatatctgcatatcatatcgatatgtcaaatatgtatcatatagtgccttccataaaaaaaataaaaaatatgtatcatatagcgggtatatttgcaaattatctttactattctactattcttaattatcacttgagcaagtgggaggaaccattttgccataaaccgtgggattaatacaggctgaaatttattagaagttgcataatagggtctctcatctcttgtttaatactaagctattaagtttactcatgattttgtgtatttacaaataaatttaactccaatattttgtaattttcattttattttcggatgaatgaatttgaattattttaaaaaataaatcaaagtagcaattaatttcctaataaaatcttattaacttaaaatttcatgatgcagtttgtaactttatcaaataatacaataatcaacccgtgcacttgatattatataattataaaattattagattatttaattatattatataaggaattataccctacgtgtgcttacgatcttcgacgaagattaatcattattttcgatcgagttacttcatatgagtatcatggtataacaaaattatataaggtatttcaaattgaatttatctgatggtaatttattcttttaacagaaaattaatttcagttgctacaacaatttgccgctgcattaaaatgtttttacagataaattgttattaatttactgttttgaataaaagggtagtcttgaatatagggggaaggggtggttggctatgaaatatgatatcgattcctctgaacaacatggtaactttgagtgtaagaaatactttggatgtcatcttacttctgctgtatgattggacatttttctatagcttcttcattcttcttgttcatctttgactgaggttctacagtggctttaccaaagcatgtatacagtcattttaattagttggtcccgatcatgctgcaaggaaaactttctagagcagtcatgtattactattttactccttagtgtggaaattggaaaatactccggacatggcattaaatattctattgtgctaaatctaaacataaagcaaatgtaatgtatatgggctcatttaataagcagttgaaaaggagccatgtctatactaacgttagcagttaaggttcaggcattcagcagttatcatgtctcaaatcttaaatacagccaaaatagcttattattagttcattactacgaggatcgggatttatccaatccatttctatgattagcattatgattcctatactgataatcaaacacattttttacaagattcaattcacaatggatttgtagaaagtggcagaattgatcaaaggaagggtccttgcgtggttattccctttctttttctcgctttgtgagtatatttttcttatcggcctctggtgtttaaaactaagaattagactgcacttgtgcaagcattattgttaagtcatcccgaaaagaataatacgggacgcttccaagtaccaaccaattccaaagtgctgtcaccttgctgtttcatgtagctatctgttttgttttgtttttcttttcattttacattccaaatgtccctgtattgtgttctaataaactttcctttgcgtttgagtagatcaagtagcagaagagcactgcatcatctttctacatcatctttcagcagaacatctcggtgttaagatccaagcaagagagcactgtcctgttagtctatctaccattttggtgagctgatcacagttgatatcttatgtaaactattccttcaagcaattttacggtcttagacaaaatatattaagggggtgcttgaaaacccttagtttagttgaacacaaacatcatgcaaacagtagattcacactttccaatgcacaaaaataggaagcaaccatatctacgttgaacatgggtttgcaagttttcaactgcaaactgttggaagtgcattggaaaatgggaaatgagtaaaacaaacacactccactccacactctaagcaaccatcaacactcaacttatttctagtaacgtaattaactaaggtctttgagaaatatgttcaatgagtgacttgctgtaatgacgaaaactcaaaactaaatttagacaagatccaacaaggatgttctctctaaggtacaattaaacaatcataatcaaagcagcttaacaccagcttccctgagagaatcaacaaccgctttaaccttaccatgatacttctgctctctcttcaagtgaacagaaacagcgggaatgttcttaagcaaaaggcgttctgctagtatcttcccaatctttgcagctgcagccacatcgcgactagtttccaagcttgatctcaacgctttctcctgcgagcttgcagaagaggctacagtagcagttgggctgtgaatcacctgggcactcacatacttattggtaaaatgcatcttcagaacataaggtttgagaaattgggtaatcctgggaggcctcactgggggtgggataaccatatctgttttacaatataattataaaaaaaaaaaaaaaaaactttttgtgtgtgtcatttttggcatacacataaaactcaagaaatgaacgactatcttcaagaaattatcaactctcagccaagcatttcaatgtatctacaaaatgtaagttcatttcatgtttagtaaatgcaaatttcaaaacatcaactaaatataaatttcaacattcaacatcatgtaaaaatacaaaatgaccgagtatgtaattgtatattaaaaaacccaaaaagcgaaagatgagttaagttagaattattgggcaaatatgaaaaaaaaaaaaaaaacgatttgtttcattggcaactttgatcaaacagttgaaaggcaaattgcttgacttaacgggttaaggaaagaagaatgacgaatataagaaatggaaggaggcagagagagaaggtgaaagggggaaacatagatacctgaattgagctgaataagatccaaggctctctccctctcgctctcgctctgccctcacaagtcacaacccactttctcaaataaatgtttacgacgctgtccttctaatatcttctttctttttccctgtcctttttaatttttttcttttaattcttaaacaaatattttacgtaacttttttgtccctatatttctcaataattaattaaataatatattgataaggttaattaaaatttatccaataattcgcacctattagctttttttttttactttaaataatgtataataatgtattaattaatatattaataaaattaattaaatactagtaacttattacttgtactatcacgatatcgccactgaaattcaacttagtgaaataaaaatcatgaaattttattattattattattgttattaacacacatttgaatttttcaattttaaaagaataatttctaagaaatagtaagaaaataattagagagttttttaggttaaataatagtagagaattagatgtaattttttttaaaattttttatgtatatcaattgacatgtaattgttcgtgaattcgatttttaaatatttaaaagaagaatatagtctcaaataatagtactaccatgcttataacatataaaaaaataattatttgttcgaaataacttcaaccaaacacataaaaaaggattattaggtaaatttaatgatttattcaaaatatatgaatcccttaattacataatatattcttgctgctttttagaaaaatggaaactgatttcgtactaatcacacgaatagttgtttccagttaaaacaaacaactttatctttttttttttttagtttttaatttataattatttaaaaagatctaacaacttatatctgatgattcgtatgttttgtgcatctgttttctcgtacttaatagcaataatcttaaaaaaaatattgttcgagctattttagaaattaaatttgaacaattgtttcaactaaaatatagttaatttatttttttaaaattgataattaaacataatttcataattagcattttatttggtccttaaattagaggaaaattggcttacacacaatgttaaaggcataatttaatttttcacttttttttggagaagtaattatatttttcactaagaccaagtatccttatttgaattaagataaaatgtttcaaaggtatctcaccaaagaatcaaagtgataagggataatgctttgaatgaatttgtataaacttaaaagaaataatttttactattagaaaatatatttttaatgtagtcattttaatattaattttattaaaattaatgttaaaaaagtgtgataatatatttgtaaataaattaaatttattaacatcatttttttttaaaattgatgtgaatatcagttattataaaatttaatgttgtttgatgcttattttcattgatttttatagaaagtggcattgtatttttttccaaattaaaaaattcaaaatctgtttcactctcttattttcgcgctcactctcaccactctcagtccacttccaaaatcccaaaacaacgcttcccaaacccttgacactcacttgcgacactgctcgccgttccctcatctctgaagtccgctgcgatggcgtctacatcgtttcgacgctgctgctgcgatggcatctacgtctacggcgtgaactctctttgttgtctttacccttcgtcagccatcaatcgccatcgtcgtaattctctaaggaagaatccgtgattgtattattcttactccttctttccttcgtttcttgtgtttttatattcaattattgaatagtactcgttgaggcttcatggaaatatatatttagcggtgatagagtggaagccatcggagctaaagctcaagggttcgctgtctggcgttaaggtcgtgactggtttggtagtggtctttgatgatgaagatatcccttaatatatatatatatatatatatatatatatatatatatttacttacttttggtatttctttaatatactaatgtgaggattaaaatctataagactatataattgtaacagttttgtgacttctatccctttctatttatgttttgtatggtagtgatacactagggtgaattgttcaatgtggttgttttaatcatctattattttttaattgggagacaagttgtttgattctattcgcatttgcttcaattctggtttgccttctttccttcaagaaggaaaaaggttagttgatgaagaaatttgttggtggctggtgcggttttagatgctttaactttttaaatatgagagtggacccatgtctgaggggctttgtctgatttcttggaacaaaattcgttgatagtgatagtgatgtcccaattggacaattgaagctactttgctgagactgtaaaaatgatttgcttttaaacaatcacctaatttaatcatgttttacctgattctgataagtcattcggttttgacattgttgttgaagaggcacaacgagctcatgtggaagcagaaagcactaagaatggtatcggtattgtcaagttaatgggtctttacagtggtcagtatcatttatgttatggtagtttacaagtttagtttgttggtatagagttgaagaatactcaagaattgacgcaacttagtggttagtggttagtggttgttgtatgtgtgtgttttatttcattgtttgcttctctttatttttgttgaattctccatgaagtttttgctagtaagttggatcatgaattgagaatatttgttgcttgagatcctaatgtctttttgaaggtatcttaacacattttgcttgtgtttgctagtggtgagaatttgggtagtttgcatcagggaataggttcagacttcattggcactgatgcttaaaaaatgattttagtcaacactctgtattcttcttctgctgatactgatatactgaaactgaaatagctaacaaagtgtatccaagagatcttgcaccctctcttgctctttactggtttcttgcctttttcgttcggcatccctctcctcttaattatctatacagttaaactattccacctaattatgtatacaaattagttttagcattttctcacgaatctaagatgaaatcaattatctatatccagaataatttctcagatgaggaagacagaataatttgcagcctttatgttaatattggaagcaggtataatagttaccaacatttaatgcaaaaacactatcagtataggccagacaatttttttttagccttttctcaccaatcaaagctgaaatcaattatctatatccaaaataatttctcaaatgaaaaaagacagaacaatttgcagcctttatgttaattttggaagcaggtataatagttactaacatttaatgcaaaaacactatcggaatactgctgaccaaattattttttgctttttctcaccaatctaagctgaaatcaatcatctatctaattaagttctcatgcatgccaagttgatccaagtgcaacaccagcatccgctatgtctaattaagatattgagtaaataattttttgttcatagatttgcttcctctttctcatcacaaaaaaaaaccttcatttccatcacctacccttcaactaaagtcaccgtttttacgattactttactttttgagttccaacaaaattttgattcttgcaatagttttaattctgttgtcaggcttgagtttattagtcacatggtcaaacatactctttccaggttgtagaaatccttaaataccggcctttgtggtttcacgactgtcaagctgttgatgttttcaatgtgctacccacaacaaatggtggaaccattgagctgctttataaggcattttcaactcatctattttatgtaatgccaggggtttcaactttcaacgaggcactcaatgggtttactgatgagggatgaaggtcaagttatattgcccctagcacacataattgagcatgaagaggtaataaattgtcactaattatgcaatagaactaatagttttgcaattcgaaatttactcatttctatcttcttcgtgctagtttttggaagtcattaaattagaaggaattgctcattctcctaaagacataataacaccaagagaaaaaaacatggggtgcaacttgaaaagaaacacaagggatgtgagtgtaatttactcttaaaaaatgtacttaatttcaacatcggttgtggttgcaacttatgtaaaaagtgttttacaacatcgattgtgaacaaccgatgtaaaaaagtgttgtcaacatttgtatttgaatcgttgtcgaaagttgttcactttcaatgacggtcgattcaacatcgttgttaaaagtcttccaaaaccaatgttgaaggctttttttgtagtagtgtttacaacatgtgtgttttttttaaatgcttttttaagaagataagatttgattcctaaacaaaataaaaaaaattattttaagtaaaaacaatttagataaacatgagagaaaaataaaaaaaatacttattttattaaaaaatatttttaaaataaatttaaacaaactcgcttttaacattgatgaaaaagaatttttaagtattgaaattttacaattagaagtttatcggttataagttagtgttaactaatgaattaccattaattaatagtaacaagctcaaaccaaacaattgctcggacaaatttacattgatatacaactttattaatcattagttagtgttaactaatgaattatcattaattaatagtaacaagctcaaaccagacaactgcacggacataattaattacatcgatatagaactttattaatgatatgttagtgtaagctaatgaattgccataaatagtaacaagctcaaaccagacaactgtacggacataattaattacattgatatagaactttattaatgatatgttagtgttagctaatgaattgccataaatagtaacaagctcaaaccagacaactgcacggacataattaattacattgatatagtaattatatgttagtgttagctaatgaatttccattaatagtaactaactcaaaccagacaattgcacggacataattaattactttgatatagtacaagtctgttcacattgttaatggttttgaagcttccagactcaagtataaatagagttccatcatattttgaaaacaacattcatcgctaaagagtacaagaaaataaagtttatcaataacaacatggatatgaagttgaatatttcagccatcaatgttttattcttattgctagctatttctagtacaactcaatcggttgacattaatataaaaaaatttggcggaggtgcagatataacacaggtaaaaagcagttgaattccctaaaaaaatgattgaatattccactaattattattattggtattgtgtttgatttgtaatttatatatatgttgtcctcaaggctttgacaaaagcttggaaagaggcatgtgcagcaacaagtgcaagcaagattgtgattccaggtgggtcatacaagatggaagcagttgaattaaaaggtccttgcatggctcccattgaaattcaaattgatggcacacttcaagcaccggctgacccgaatgcactacaaggggctgatgaatggctcaaagtacaatatgttaacttttttaccttatcaggtaaaggtgtttttgatggtcaaggtgcaactgcttggaaacaaaatgattgtggaactaacaagaattgcaagacacgttccaaggtaataaataaactatataactatatagccatttcaattaatctcaaattgctagcacagtcacttctaccaaaacattctaatgagctaaatttcttgtaaacagaattttggtttcaatttcctgaataattctatggttcgggacataacttctaaggatagcaaaaacttccatgtcaacgttttagggtgcaataacttcacattcgatggcttccacgtcagtgctccaagtaccagtatcaacactgacgggattcacattggaagatcaactgatgtgaaaattcttaacaccaacattgccaccggagatgactgtgtctcattgggagatggcagcagaaaagtaactgtccagaatgtgaattgtggacctggtcatggcattagtgttggaagtcttggcaagtacccaaaagaagagccggtagaacaacttctagtcaagaattgcactttgacaaaaacagacaatggtgtgaggatcaagacttggcctagttctccaggagcttctcctattactgatatgcattttgaagatattaccatggttgatgtcatgaacccagtgatcatagaccaagagtattgtccttggaatcagtgctcaaaacaggtacttatatgtttaatcagacacgattcttaaatttaaatgtctttatttgtgaccctttttataatcatactggagttgttattatttaaatcactagtattttagtcttgattgaatatgcactaccgtgaggtttcttataccttgtttttgtctattttgtgcatgcttgcaatggcttagactccatcaaaaataaagataagcaaggttaccttcaagaatattaagggcacttcaaaaaccaaggaaggagtgactcttatatgtagcaaaggtgtaccatgtgagggtgtggaactaaataatgttgctcttacattcaatggagctccagtagttgctaaatgtgctaatgtcaagcccaaagttactggaaaagctcctgcttgcacagcttaagagacttgggttgacacattctccttgatcagatttttcttttgtagattcataagcatcgtcgtaaggtgacgatgaggactatttgaagtctatagtgaataagcatttgtatatacttatgttgtcaatgtctaagggtattcattcaatacgaaatccttgtgcaagagcatatatatatataagactgactttctatttactaaagaaaagttctcatgccggtcacaattgctagctagaagctacgaggctttcctgtcttcgcatatagtgtattctatatatcactattatttatattagaataagagtatatatttatgtacaaaaaaaaagagaatatttataaatatgcttgaaagtgtataatatatttcaaaacaaattgttcaggtcaaattatatttgagatatgtatgccaacttcaaaatgaggttactttattatcgaatgataatgaaacttgttgaagatgaagaagaattatcaacaatcaatcacttatccttatctattaaggtttaaatgaaatcatgtttgtgcaggggtgatatactgtgaacaataaatatgtatatttctgtaaataaaaattatacatgtatgtttatgtatatattaaatttttgttatatgtttgtgtgaaaaatcctaaagtagaccttagccatcaaacacccactgaaaaaaaaatatagtctcgtatttctaaaagaattaatctatatttaatttttttgatattttttatcgggtgcattgttttattagtgatgcttacaaagttctacaaatctatgttaaacgatttggttgtgttaagaatggcaatggggtaaacaagtgtaataaaatactagatagttcacaaaatttgtaaaaatactcaaatggggaaaaataaatccatttatcacatatagttttgaatttgtagcataaaatattcccctttagaaaaagaatcaaaacatatggtaacttattcacgggaccctagatgggtaaccctttaatgtttcacactagtaacaaacaatgcaaaaacctcatatacaatatgctaaaagcaaaccaaaatgacggatgaagaaacaaacaattattgagaagaacccaaaactttgcaagacataaaaggcaaaaaatctaccggaaaagaaaaaggaaaaaagaaatgttgtttgtccatcttttttatattgctgcctcacaagtgatgcatgatacacttccgctatatcccgcaatcagattttacatctcactcaaatcccataacctaaacagcaactcaaaaactcaagccttaacattcccttgtaacctatctctatatctgaaccctcaaaacaggtactccagttagctctagaaaatcaaacatcttgcgtcttaaatcgaaattcggtaacaacagtggtgtgcaaaattcacaattcacctgcttcactggattatcttcacctacaagttcgtgtcatcaaaacgatcttcctatgtagcgattcctgaagtaaatatacaagtttatcagtgttggcatacaagacaactgaaaatgaaaaactaaaaggacacttcacaagtataaagcatcaatatttatttccatccaatttatatgttgatgtgaaaaaattgagcactacaaaggaacatacaacagaaagagtataagtgaattgtagtcaagttttgctaaaagaaaaaagatcaaagataaattcacatcataaagaacttccataacttaccaagactaaagaaattgagattcattgttagaaaaaaaatgaacatagtattacatatcataaagaagaaaatgatgtagaacatattttactcttttacaaagaactcggcgttatatcagccctcttgactaactattaaacatcaagagggtaaaacttcttacattgccctctaagtgggaggggtagagcaccagaggaataacagacaaaaaaaaaacattcaactcttgaatgcatatagcttgctagtttacttcattattaataataataataataataataataataataataataataataaatgttttatcatgtttttcttcttcattaattcgtatttgtgatatgagtgtgaaatcactcgcaatattgttatcaagatatgctacaaatgtttattgttgataaataaaatagcatataatgatattaacattgaagaataaataataataaaagtttgattgtatttttttttctttacattatatttatgatatgagtgagaaattatataaatataaaatcacttaaaatattattaggattatatgctacaaaattagacttatatgtttaatgattatattcaaattaaacatgtcttatattgagtttcatcttgaatttccttaaaaaaaagtttgataaccttgaccaattataaaaatgatgaaaaaggatttttaagtattggaattttacagttagaagtttatcagttataagttagtgttaactaatgaattaccattaattaatagtaacaagctcaaaccagacaactgcacggacataattaattacattgatatagaactttattaatgatatgttagtgttagctaatgaattgccataaatagtaacaagctcaaaccagacaactgcacggacataattaattacattgatatagtaattatatgttagtgttagctaatgaatttccattaatagtaactaactcaaaccagacaattgcacggacataattaattactttgatatagtacaagtctgttcacattgttaatggttttgaagcttccagactcaagtataaatagagttccatcatattttgaaaacaacattcatcgctaaagagtacaagaaaataaagtttatcaataacaacatggatatgaagttgaatattccagctatcagtgttttattcttattgctagctatttctagtacaactcaatcggttgacattaatataaaaaaatttggcggaggtgcagatataacacaggtaaaaagcagttgagttccctaaaaaaaggattgaatattccactgattattattattgctattgtgtttgatttgtaatttatatatatgttgtcctcaaggctttgacaaaagcttggaaagaggcatgtgcagcaacaagtgcaagcaaaattgtgattccaggtgggtcatacaagatggaagcagttgaattaaaaggtccttgcatggctcccattgaaattcaaattgatggcacacttcaagcaccggctgacccgaatgcactcaacggggctgatgaatggctcaaagtacaatatgttaacttttttaccttatcaggtaaaggtgtttttgatggtcaaggtgcaactgcttggaaacaaaatgattgtggaactaacaagaattgcaagacacgttccaaggtaataaataaactatataactatatagccatttcaattaatctcaaattgctagcacagtcacttctaccaaaacattctaattagctaaatttcttgtaaacagaattttggtttcaatttcctgaataattctatggttcgggacataacttctaaggatagcaaaaacttccatgtcaacgttttagggtgcaataacttcacattcgatggcttccacgtcagtgctccaagtaccagtatcaacactgacgggattcacattggaagatcaactgatgtgaaaattcttaacaccaacattgccaccggagatgactgtgtctcattgggagatggcagcagaaaagtaactgtccagaatgtgaattgtggacctggtcatggcattagtgttggaagtcttggcaagtacccaaaagaagagccggtagaacaacttctagtcaagaattgcactttgacaaaaacagacaatggtgtgaggatcaagacttggcctagttctccaggagcttctcctattactgatatgcattttgaagatattaccatggttgatgtcatgaacccagtgatcatagaccaagagtattgtccttggaatcagtgctcaaaacaggtacttatatgtttaatcagacacgattcttaaatttaaatgtctttatttgtgaccctttttataatcatactggagttgttattatttaaatcactagtattttagtcttgattgaatatgcactaccgtgaggtttcttataccttgtttttgtctattttgtgcatgcttgcaatggcttagactccatcaaaaataaagataagcaaggttaccttcaagaatattaagggcacttcaaaaaccaaggaaggagtgactcttatatgtagcaaaggtgtaccatgtgagggtgtggaactaaataatgttgctcttacattcaatggagctccagtagttgctaaatgtgctaatgtcaagcccaaagttactggaaaagctcctgcttgcacagcttaagagacttgggttgacacattctccttgatcagatttttcttttgtagattcataagcatcgtcgtaaggtgacgatgaggactatttgaagtctatagtgaataagcatttgtatatacttatgttgtcaatgtctaagggtattcattcaatacgaaatccttgtgcaagagcatatatatatataagactgactttctatttactaaagaaaagttctcatgccggtcacaattgctagctagaagctacgaggctttcctgtcttcgcatatagtgtattctatatatcactattatttatattagaataagagtatatatttatgtacaaaaaaaaagagaatatttataaatatgcttgaaagtgtataatatatttcaaaacaaattgttcaggtcaaattatatttgagatatgtatgccaacttcaaaatgaggttactttattatcgaatgataatgaaacttgttgaagatgaagaagaattatcaacaatcaatcacttatccttatctattaaggtttaaatgaaatcatgtttgtgcaggggtgaaaagggaaaagagcacatggtgtacaaacttaagaaatcaatatacatatttaaacaagcttcaagacaacggtaccttaagttcaatgatacagttgtttcctttggatttaaagaaaacactattgatcaatgtatatatctgaaggtcagtgggagtaagtttatattactgattatgtatgttgatgatatcttgattgcaactaatgatcttagttttttaaatgagactaagaagtttctctttagtaactttgaaatgaaagacatgagtgaggaatcctatgtgattgggataaaaaaaattatgtgatagatcacaaggattattgggtttgtctcagaaagcatatattaatacatttttagagattagaaatgcagaactgctcatcgtctccagtaccaattcagaaaaggagacaagtttagtctcatatgcatgcaatgtcctaagaatgaattggaacgaaagcaaatggaagcaattccatatgcatcacttgttgggagcctaatgtatgctcaaacttgtacgagaccagatattagctttgtagttggaatgttgggaagataccagagtaatcctggtatggatcattggaaagctgcaaagaaagttatgagatatttgtaaggcactaaaggtcacatgcttacttataggaggtctagtaacgttgaagtgattggatacacagactcagattttgcaggatgtatggatacaagaaaaattacttatggttatctgtattttttagctggaggaactatgtcatggaaaatggaaaagtgtgaagcagtcggtaattgttgcatccactattgaaactgaatttgtgacatgctttgaagccatcgttcaggctaaatggctgcaaaaatttatttcaaggtttgaattggtcaacagtattgatagaccgctgaaaatttattgtgataattcagtaacaatcttcttttctaaaaacgacaagtattcaaaaggtgttaagcatatgacattgaaatactttgtcgttaaagaagaggttcataaacatagagtgtctatagagcatgttagcactaattttatgttagctaatcccttgacgaaaggattatcgtccaagacatttattagtcatgtatgtagtttgtgcattatgtcagctaatgaatgttggtcattattgtaattattgactattgacactctgaattcaatgatgtttaagtttttaaatattattatgttttcaaatttatatatacatgcatgtatgaatgattattttgaaaaataagatttgtccctaatgaagacatataataatattattgtgggacattatgatgtaaacttttattaaagtatcatattaggaagaagagttaataaagtggtacatggaaggaattatgtcgatttgatagcatagaaccgtcatgatttttattagttttatttctgatcatgatttatgaggagaccagtgtatgaaaactttagccctatgtatgcgcattataattgttttcattaaatcatgaaatgaaagttgtgatatgagccaagtgggagaatataagatttatcattgtggctcatttaaataaatgttatttgatttaatgaataaaggacataagggtaattggttacaaagagaagttattaaaagaataactgttgataggtgcaattatcttaaaatgataactgttgataggtgcaattattttaaacttagtggttcagtttctaataaattgaaatttagaaaactgaatacattcatttgtctgtccatgaaagttgtatcttatccctattaaaagaagttacaagaattgaaagggttaagaccatgagaaaacatcctaccataaaagatcttcagtaatcatggacaaaattatgtttatgtgaaactcatgaattttaaagatcttattcataagatttgatgtgtttgttttaaacagaaattataaatttatatttacacaaaacacaccagtggagctcgtgcgccacgcccaagaactcataatctttctcgactccaaaacattcactcgtgaaagtaaacgcaaagagaaggtaaattaatgtcttccttccatcacataattaaaattacgtaacttgtcttacctgactgtgcattcataattaaatctaagattgttttttttcttttgaaaaggcaattttattgcaataaaaaaatttgacacacaggatgtgttccaaattatcaaactgaggacacgagaaattctagacatacccccgtcaagcacaaggttttaaacagcagtccgcaatcgcaattgcagctgcgacgtcaaggtatttctgcaatcgcatcatgaccctaattgtggttgcatcattcgtattttcttgcaacataaaggttttaaacaacggtctgcaatcgcaattgcagccgcaacatcaaggtatttctgcaatctcatcatgaccctaattgtggttgcatcatttgtattttcttgcaatataaatttttttggctaaccgcaaccatgaccacaatttataaccatgatcacaacagaaaatgcatcaggcacatacaacctgttatttatcaaattatgcagcctgaaaataaaaataaaaaataccagaagctttgctcagaattaataccctaatatatacgactgccaccgctatatcatacttcgcaagcaccacaccagatactcaaactcttttcacgcttcagcaccaacataacatgcacgtacaacttttgaaaaaactgatatttgatactttttaaaattacatcagtttcgtcacttttttaatatcgagaaaaaacacaaataaataaatatggttgatgtgattacaattatgattgcgttgtagttgtagacattaaaaattaaattaaatgttgacgttgcaatcaaaatcatggttgcattactatttttttttatgccatgcattactatattttaaaaccttgattaaatcatatatatatatatatatatatatatatatatatatatatatatatatatataaaatgcatgcgttgcagctatcagacctaagcaaaacgtactggagataagaacggttctttatggaaacggagaatcagagccaaatgctgatgcgtgttctcagatcacatgagagtttttcaaagatgacacatttcgcattttcattctctatgtatcaaatcttaaactcggggtagccatttttatatttcaccgtcagttacattatgtttttttaatttctctttctagcatatttaagaattaattcatatatatatgtcggtaggcacgccaagatgcaacccacgtgattgcaatcttgcaaaggcagcgagttaattcaattcgcaactaattgcttctcagtacctggaaaaaaatatagatcttgtggagatgctcatagacgggtaagaatatttatgggatattccacattgaattttcaaattttatttcatagtttcagtactgtgctggataaatggttaataaaagttgatttaattagttatgagaaagagggtgacattgctttgacgtatggtgcggttgcaagggagtgcatgcgccaccagagcgtagcaaggtacgcgattccaatcatcgacctcaattaattaatataatcatgcaatttattgagttatatatccaacatgaatgcttgtgttaggatcataattcttaattgttaactttcggagattaaaaaaaatgtagccaagcatcttgcatggctgactttggaattttactttctttttcctcttttttaaattctgactagcttaatttatgttttttaggcatattttggaatcagagcacatgaagaagttttctgattatattcagctaccaaattttgaaagagcgtcagatgctgttgcaacttttaaagtatgctaattatgatgctatgtcttttaatttccattcacaaatctaagcctaattctcattatttacatgttcttcattttacttgcattgcattgcgaaaaagtcccaaaatatatctctagtatattgcatacatatctacgtacgttatttatattctatattctatattggacaatggagcaaaaggcataaaggatactgcttttttttcgcattttccgagagaaaatgaaatatgtgatgaaagaaatatacaaaaagaaatgtaagagaaactatcatccataatatatttttatcttgcatcttcttatttaattttcctttgttttatgcgacatccaaacaaataatatctttaaactatccaggcttaattatattgatttgaatgtatgtatgcgaagaactctttgtatttgggaatgtgttttatgataattgttttgtataaataggctttgacatgtaaaactgatatcacaactgaaaaagtcgattaactaaaatgttttatttttatatcaataaatattaatttgttaattttgttagaattgttaattttgaacttataacttcttctctccaactcccttcactctaagtcttcccttttcaaaaaaataaaaagtcatccttatatctccctaattaactaaaatttgtcatataatgtgttgctataataaagttctgggtactactattttgctcttacagcaaattcattagcatgaaattaagctaatccattccctgactgatgtacacaggagttattgacaaggcacaaatctacagttgctgaatttctttctaaaaattatgactgggtaagtacgccaaagtctacttagtatataattatgtcatgcaaaaggtacaagtatttatcctctgtaaattcgagaatgtaaaagcaatcaaggctgtagaagagggaaagaattttcccctatcattgttttatctttttgtaaaagtttaaattagacaatttaatttggtttacaaagatttcatcagttgtctttagttggtggcttcctcggtggaatgtaaggtttcgtaccttatatataattgaggtcaacattcacaatgaggcagatatgaaccaaaaacttattcacattggagtcaattatttgaataaaagaagtcatagcttctttcacaatcctcaaatttattctaacataagtaatttggttgttttcatacaatatagctttttaagttttttgtttttatcaatattttaatatattatcagctaaaacgttttactgtgcctgttagttcttcaaagagtacaactctcagttgcttgaatccaccagttattttactagacggtacgctatcaaggtataaataatttaatctgtggtagattccttaagtctcaaattcatttcagcatcaattgtccattttaactgcttgcattagtcacaattttttatccatttcaccattgtaatcaaattaatatgttacagttattgggggatatgttattggatcgctcgaatgctgctgtaatggtccagtatgtgagctcgttcgataatatgaggatcctcatgaatctcttaagagtatatatgcattatcctatactcaaatttttcagaattgtaaattcatgaaataaaagtacttattaatttgttcactccccccccccccccccaatttgcaggattcaaaataagacaattcaattggacaccttacacgttttcaaggtgtatattgaaatggagcaagtatatattttttaatagattcttctaaactcagtgttcttagtttaaatttaattattttaattgacagctatttgttgcaaatcaaaataagcctcctgagattgtcagcatccttgttacaaacaaacataagcttttgcaatttttggacaactttaatagcgacaaaggtataaagttgttgcttcacttctagggtataaaatttctaattttttaattggtcgcatgagttaactctatccttccttaacttttcagcggacgatcattttcaagcagataaacaacaagtaattggtgagataataactcttgaacacaaggatcgtccatgcacatctttggacaattgtgaagttccatgttgaatacttacagtccggatttttaatcatctttcaatttctccaagtcacattttgctacgtgaagtcgatcgtgttatttttttcttttccacatgtcattctcaatgggaagaatcaaatatacttcactgtgaatagaagatacaacgaatttggattaacttattatttgaattatttatttgtttaactttatcttctgttatatttatacacttgtataagtcaagaacctttccacaccaacaatttctatagcctcattatccgtcacggctgcaaaaaagcatcccagcagcaatcaattctggactgagcatgaagcggatttcctcctatatctgacatttacaagcaaatttattgaacatcaataggctaaaacaaaatgttcacgtgacaaatatctcaacttacaaaattacaaaatgtacacgactgcatgcatatgcttatatcaggaactatggtataaaagctatcataaatacctaggtataatggatggaaacaaaaaacatattgtaactgtgaagtccccatgccaaggacatctcccccaagctttttacttgcaaaatataattcaacggctacacttgattgattttccaagtggcctgaattgagaagctattacaatgccaaagtattaactattaaaaaccaaatgaatcattaaaaaaaactgaaagaaattagttttgctgacaattgaaaatagatttccttcatttaccaaaacattgcatagaggtgtacgagtcgcgccccaaagctccgcctcgggatcaccaatattagagtaatttttgaagggaaatactcttcgctcaaaggagacaatgcccttaggcatatcagaacttatcctttgaaaatagtgaaggatgcacaaaaccttatcttgcagtttttcattcatatgatcatatatatatacacactcctgaaaattaagaaaaaccttggaatattgcaagagaaaaaaaaatggactacaccaatgaccaatatcaatttcatctctatgttgcagcatgctgacactaaaaggatcaaatttacgacaaaaaatgagcaaaggattccttacgcaaacaattgatcaaagttgatcatttgaaggcctttcacatggttgtgatcgtctgggaatagacaaaataatgagcaaacaagaagagtagcaaccaactcctgaaaagcaatcacagttgtgcaatacttatgacttcagaattttcattttggtttagaaaccatcttggaggaaaaaagtagataaaatgtaataataagaaagtaagtaacctggctaaggcacacaaagcctggttggtgcgattccaatatgcgaagagcatcttggtagtgtgcttccaacaaagagatagggcaacctccagagctagcaaatctgccaatgcaggaagcacgtccttaaaccactttctagattgctctatagtcataagctgaaattaacaacgcgacacgtcatgtcatgcatgtactcggcaaaacccatgcacgtcaacttaccttgtcaaagaagaaggcatatccacggatagcagaagacttgttgggagggggagagaaagcttttctgagtgcacaaatggtgcgtgccaagtcatcggtcatttccaagagtgtattatttgaggggattgaatctaggttctcttatacatatgttgtcactaaactatatatattcctttatatgagaagttatattcaattgtctttaagtttaaattctacattttttactttttttcgggataatgaatttattgtgtttctggagttaaggagataataacaataattcaattcaatgttatctttaactaacataagacaattaaagatggtgttatgacgacgatgacattaaccaaatcaataacatttacacgtagaaggccaaattgaaaatctgtaatatatatagaaactaaattatgtgtttaaccttacaatttttttctcgaagtttgggattcaaattatggacataattaaaggacgagtaaaacacacatttcatttgcttaaaaacaaaatggatgggtaaaatttcagaagtagaatgattatggcatagcttcaaagccaagcacaatatgcaaacatcaaccttcgtatctcgtgaagacaatgactataatcaaaaggagtagccgcactcgatcgacataataatatctcgtttgatatactatattgccctctactcccaccactagatacaaattttaaaacccgatcacattgtcccatttctaccaaacgcacaacaccaccttgtctttccttcaaagtcaagcatcaaactacatactatttcgcacgtcaaagaaagaaagcactaacgattctcacttattacgagctcaaaatccataatgacagctagcaaaaattggttagtaagaaataataaaaacatgagtatgatttttattgacgatacgaaaattttatttgtagataatttgtaagtaaatgtaaaaattctttgaattttaatttctatcctaataatgatgaagttgggacccatgcaactcacataaacttttttaataataaaaaaatccatgacactcaccctgaacacaacattgttgttaacaaaagcaagcattgaaccatgaaccattaattctctcccagtctatccatcacagatccacggcaccaccatgctaattcttctttacctctcccttgtgtgttcacttccccacattgcattgtcatcccattgcaccgtggaaaccgccacgaaaacgttcgaaaaatgcatgaacctcccaacccaacaagcctccatagcatggacattccacccccacaactcaaccttagaactagtcttctttggaagcttcatatcaccttcagggtgggttggatggggcattaatcccacatcgcccgaaatgaccggaacacgtgccttaatagctttcccggacccaaactcaggccaaatagtgcttctatcttatattcttgaccccacagtgaagcttcaaaaatctccactgctctctcgcccccttgacatccacctcctctcctccaccgccgccatgtacggaggcaaaatggccaccgtgcacaacggcgccgccatccaaatcttcggcacggtgaaactgaaaacgaacaagaccaagattcaccttgtttggaacaggggactttacgttcaggggtactcgcccaccattcatccaactacttccaccgatctggcttccattgctacctttgatgtgttgtcgggttcgtctgctccacagcacacggatctcacgacgttgagagtgatccatggcaccgttaacgccatctcctggggcattttgttaccaatgggagccatcaccgcacgctaccttaggcacattcaagcgctcggccctgcatggttctatgctcatgcaggtgtgatcatcaacacaattctccatattactctttaatttcaaccattcatatttttagtttgactagacagtaaaaagctaaaaaaagaaaaatataaataatatgatatgatataaaaaatataaatgttaataaaatgtttagagtgacaaaatattcacatatcactaatctttatttgaaggatttttattccattataaaagattgaaatattccacaaacacttcaaatccatttgtttatcaattctttttcttgtgttactttctcaattgagtacatattacaaacaccctcaatgagtgtccacaaaatatatattttttagtgttatttgtgtatcagaattagactaccttaatcctctaatataaggattataagtgatatataaaaaacagaaaatagaagagcgtatgcaatatgttatgttatatgatttgattaaaaaaaaacataaatataaataattaatatatatatatatatatattctaaacatatccatatatcattaaattaatgatttaaaaaaaaaaaaaaaaaaaaaaaactcttcgggcagtcatttaatacttgtttgacaatgacttgtgttatagtagtaattgcttaatttgatgataataagaaattggacggaaaataaatattatgcatgcaggaatacaactgtttggtttcgttctgggaacagtggggtttgtgatcggaatccggctggggcaactgtcgccgggagtagagtataggctccaccggaagcttggaatcgcggtgttttgtctgggggctctgcagactctggccttgttatttaggccaaagaccaggaacaagttcaggaagtactggaagtcataccaccattttgtaggctactcgtgtgtggtgcttggctttgtgaatgtgtttcagggatttgaagttatgggagccagcagatcttatgccaagttgacttactgcttagggctctccactctcattggcctttgcattgctttggaggtcaactcttgggttgtcttctgtaggaaatccaaggaagacaagatgaggagagagggactcattggaacttccgacaaagccagtggaagtgccatccacaattaacattcctcattattactctagtatttcatttcattgttccttaatttctcttttaattcattttctatccaatgccaagttgtgcaattataaaggttttgaaatatacttcctttgtctcaaaatgaatgttgtttaagattttttcatacatatatgtcaaaaaaaaatatattctaagcgaattaatattaattaagatatcattcaatttgaattttttttcaaagattaagaagtaatacatacatactttcactagcttctattaatgtttcttagcaatagttcaaacatgacgcatgaattaatgatcatttgggagttccactgcgtcgaaaggtgatgcaggcaagaaatcattagatgatccactattattacttattcatgatttctatcatttttatataaaattaataacactcgattaaatgtaatgtaaaatttgatagtgaatatgtggtccaaaacctttataatttctcgcatgccacggggaaatgtcaagtgtccagtccacacactcccacactactatgtaaggtttgtgagagcaattggaggattaaagcggaaaagagtgaatttttttattgggctagcattaataccttcggacaactcaaattcacgggtattaagttgcaagttgaaacatctcctctccacttctaaaataaaactttgagtattttgaaattagcttctattaatattcattaacaatttttcaatcaactagctagtatttgctttaagagtaattttacttcataatatctaaaccatttcaaaacttaaaataaattattttatcatgaattcttttatttaagtccaaaaaaagtccaagtagccaagcaccacacaaaaagaagaatggaaagtcgtacgagaccatgtctattcctacccgttataacttgtatgttattcgatattcgttgcttcccactatccacttacatggcttttttttaaatagaaaaaaaaaaatcccagcagagctataaagaaatcagtcaaatgacccaatgtagaaatagggcaaatgaaaggatgtgtaaacggcataacatatagaaattgtattaaacaaatacaaaaataggaaacaggctcaaacgaggagggaagaaaaattaacaatatagaaggttttcactttattcgacttcatgtcttctgacttctggggatgtaatattactttccaaaatcagccaacacattttttcttttcctaataaatatatttgtttggaatgatgctttcgaagaaagtttttgtttgacaaatatttaaagcaaaaagaatctcccaaagtcttttgcttttgatttgtctgtctcttgatctaaactaaaaaatatcttctataggatatgatattattcgactcaaaaaacatttatatgatgataaaattaactctaaagattttcttttctatacacaactggaactcgaaagacaatttttatttagtaaaatatactgagttagttaaaatgttcaaaatatctttaaaaaggaaagaaaggcaagcagaaacagattttagaaaataacaattgaatacctttttcaaatattttgaaagaaaaacaagcaattttctaaaattgcaacaagtcaataaatacaaacacacaaaaaagtcatttttcagctaaaacaaaaaaaaataaggaaccaaatttaatcgtttatttggcctcattatttatttatttaatttaattttgtctcactattaataaatgactcaatttggttccttaatttttcaaataccatgcattttagtaatttttcgtctaaattggtctcatgctgttagaactttttacaaattaaggaacctaattgaatcattttaaagatttaagagatcaaattgaatcatttattaatagtggaataaaactgaacaaaataaataagcaattaagccaaaaaaaattgtttattaccatccatcaaaaagtcctgcaataattagatatttagaccacaagagttaaattaaagaaaaacaatatcttaaatgcctaacattaaccctcaggaagattgaagatcggaacagtttctaatctactcaagaaggatgtgctaaacaggcaagtacaacacctaaatccaatttatctatctatctatatattttatatatctatacttaaagtaaaggaagtttgaagtattttaaaccattatatcaagattttaatttcattatcatttttaatttgatttaatcttatttagtcattgatcaaaagttacaatacacaataactattgatttagtttaatcaaatagaatattagtgaaggattaaattgacctcattaatgtaatttaaaaaaaaatatttcactttaattattaattaaggatagaattatttttaacaaaaataattaaagatataaatttagatatatatatatatatatatatataatgtttcatatgaaaatgattttgttatgtaagaatgagaacattcaaattaaaacattatttaattataaaatctctaagatttattaaagaaaatcaaatattttaaagatttaatttacatcaagatcgtcttcacaatcaccattattgtcacaaccatcatgatcgaccaccatcattatcacctagataactgccacaaatccacctacatgactgccacaaatatcatatttaattttatggttaaatgatactttaatttgaatttaaaatattttaattgtgacttttcattttcattttaatttaatagataaagagaatggttgttctaatacatcaaacacccactgaacagaaaatccagtctagtatttctaaaagaattaatctatatttaattttttgattttttttattgggtgcattgctttattaatgacgcttacaaagttctacaaatctatcttaaacgatttagctgtgttaagaatggcaatggggtaaactaaactatagtattaaaatatctataaaagcaagtgtaataaaatactacatagttcacaaaatttggaaaatattcaaatggggaaaaataaatccatttatcacatacagtttgaatttgtagcataaaatattcccctttagaaaaagaatcagaacatatggtaacttattcacgggaccctagatgggtatcccttcaatgtttcacactagtaataaacaaaaacctcagatacaatctgctaaaagcaaaccaaaatgaacggatgaagaaacaaacaattcctgagaagaacccacaactttgcaagacataaaaggcaaaaaatctacccaaaaagaaaaaggaaaaaagaaatgctgtctgtccatcttttttatattgcttcctcacaagtgatgcatgatacacttccgctatatcccgcaatcagattttacatctcactcaaatcccataacctaaacagtaactcaaaaactcaagccttaacattcccttgtaatctatctctatatctgaaccctcaaaacaggcactccagttagctctagaaaaccaaatatcttgcgtcttaaacccaaattcagtaataacagtggtgtgcaaaattcacaattcacctgcttcactggattatcttcacctacaagttcgtgtcatcaaaacgatcttcctatgtagcgattcctgaagtaaatatacaagtttatcagtgttggcatacaagacaactgaatgaaaaattgaaaggacacttcacaagtataaagcatcaatatttatttccatccaatttatatgttgatgtgaaaaaatggagcactacaaaggaacatacagcagaaagagtataagtgaattgtagtcaagttttgctaaaagacaaaagatcaaagataaattcatatcataaagaacttccataacttaccaagactaaagaaattgagattcattgttggaaaaaatttgaacatagataacatatcaatatatcataaagaagaaaatgatgtggaacagattctactctattacaaagaacttggggttatatcagccctcttgactaactattaaacatcaagagggtaaaacttcttatattgccctctaagtgtgaggggtagagcaccaggggataacagacaaaaaaaaaaatcaactctcctatgaagatttgattgcatgcaaatcatgattgcatactctaaacgtatgcagcaaaacatctaaaatctatcagacaattcagaaggaaaaggacatcgaagaactagttctagtatgatgtttacatgacatctatgattgctatccagaagtcagttttcttcccctcattcaaattttgtgaaagacactcgaaaaaagaaggcaatactgttgaaaagagcccggaatatatatctatatatatgaaaatgatcatttctaacaattcaatggaattatgggcaacatgtttacaaattttttctgttttttttttctccatctactaactcacaaaattacaatcaaccatgcagattttgaatccacagatccatacccaactgttttcattggaaaagatgcaattagacaagagtcattatgataatctccattgaaacctcacctttattaagttatacagcttctacaacttctgttcatgaatgaagtaatacttttagtttgagaacttaatttcattaaaatacttctgcatgtgcacattgtaaaagtatgtgtaaggttgagccttgcatctagcagaattcaaactctacttataccaataaacatctgaatcactaatagaaactttataatatataaaagcatatacccctccttattcttttctataaaatataaatcaacattttgaaattatgagtcactatgaaattagaggaaaaggtgatggagcatagagattaagagaagaaacaaggattgtagagaatcaatttgattttatgtcacaaaggtgttatttctggttgacggaaaggtacagtaataaagagacttacatatggtttttattgacttggaaaaggcttataattcatgctatacaagacatgtatgaagtggtaactactagtgtgagaactccaagtggtgaaactaaggactatcctattgagacaggattacatcaaggcttaaggcttgagtccttacttgtttaatctagtcttggatgcttatcaaggacatacaaaaaattatcctaatttcatgcattttgcagatgatataatcttgattgaggaatcaagggaagcaattaacattaagcttgaactttggaggcagactttggaaacaaagggttttgcttgagtaggagtaagacaaagtatatgcattgcaattttagcaagagacgagtaatatgactcggaattaaaaattgaataagtcatatcacagctttctaagtttaaatatttgggttcaatcatacaaaatgatggaaaaaatatgaggatgtcatacaagcgggatggcttaaatggagaaaggcattgagagttatttgtgatcacaaagtacctaccaaactcaaagacaagtttcattacacaattatacgtccagttatactatatggcagtgaatgttgggctttaaagggacaacatgagagaaaagtgggagtagcaaaaatgagaatgtaaagattgatgagcagtcatacaagaaagggcaaaatacggaatgactatatacgagaaaagtttggtgtggcaccaaatgaggaaaagatgacaaaaaattggttaagttggtttggaatgtacaaaagggcccacacaaggcgacaattaggagtatattgcatgatttagtctcgtgaaaagggaaagaggaagaccaaaagggacattggaggaagttgtaagaggatctcaggctaaatattattcctaaagcttcggtttttaaccgtgccaaatggtgttatgtgatccatgttgccgatctcatctagtagaggctttgttgttgtttaataaaactataaatcaacactgtgcaccttgcttactttcctcgtccctcaaactagggacttttttttctactgttaggtatggtagaaagtccatctataatctgaaccccttcctcctctaaaccaagccatgctaaaacaaagttaggttgtggaacaatgacaatcatatacatatttatgaaggttaactttgcttgtttgttactttttgatacctatgggacctctcaattttcacatccttgaagtatattccacacaagattagaaagaaaacccatataaatgtagttagaattctggcatctgaatgacattatggttatctaaagatgtgctagtgttccaagaagcttacttatacaacaaataaggcacacagatacaataattaagggaatggagttcggaaaacaaggaatggggcaaaagtataatgaactcaaacatagataattacttatttagtcaatgtcaccccttctattgaataaccacagagcaataatgtccgtgattgaatgtcactgaacactgttctgagaaacaagctttcaaaaatatgcatccacaacttcacctaactatttaaatttaagtaatgggttgaacatagtataaacaaccaattacaattgttccattataatagcaaacttaacaaagaggataaaacattaatcagagatcaatcagataacatttcctcaaaatgcctagtatctagaaaagggcatttgtctaaattattgtaactcttacccctatttggctgcctcttattaacagtgtaaccaccaacataaccaggagaactcttggcagaaacatctgaagctgtgccaccaagtccataaccaaagggactagatccatctctctcagaatttgaagatcgccaagtggggtccccataaactgaactattattgtaaaagtctgcaaaagccccatcaacaccgccatttgatgcagagtatgaagatgttggtgcaaaagtggcaccagtgcttcttccataccctccagtccccaaaccataattgttgtcaccacctccatatcccaggttgccactactttgtgacatattgttccctcctccctgctgcccggaaattgctgaagaactccagttgactccagtgttgccaaatgtgttccctccaacactcccactccctgatccaatgtatgcattggagtttgcagaacttgttccataactaaggccaccattaccccacaaatttcgagtcacagaactgaagaaagaattgttacctccatttccactctcatatccaacaggactgccaaacctattggagctgctgataaaataaggatttactccccgatcatagctaagattgctattgaaatttgcattccctccaaatccagcattcaaaccaggttcaaaattcatgctcattccataacctgatccaaatgaagcaaatccacttcgaccaccggcaacaggactgaatctatcatccgctcgaagtccatagcctgcaactgtacttggagaatacccctgagtgaagccatttaagaaactattgaccctagtaagaccatagttatatccaccgagtggggtgcggcttggtcctggcgataactccttaggaactgctcgcttgacctcaaccattttaccattcaattcatgaaatgtcttaagtaagaccttgtcaactgcctcctcagaatcataagtgataaatccaaagcctctcggcctctgagtgttgtgatcatacataactacaacatctgttatagtcccaaactgatcaaagtacttcttgaaatcactctctgtcactgttgatgctaaacctccaacaaatatctttctagtgcgacctggaccaggagaaccatggatgctgccactgtttctactcagtatgttctgatcatccctaggaacagctttcttagcctcaacctagcaagagaggaaacagtattgagtatttactgtatatcagaaaataaaaaagttttcaagatctgtcaatccttatgacagatgcttagaaaagagaacaataacaaaaatcaaaagattagagaatataaaatatgtggaaaaatttaatgtactcctgctccattttaaaatctagctaagatattttgagattgtgaatataacaacatttcaacatcaaaactgctaccttccaatgttgcataattcaaaaagagaaccttaatgtcaaaatgcaaactttagacttaaaagggggaaacaagaagattaccatccttccgtcaatgctgtgcttctcttttatgactatttctgcaacagctgggtcagaaaaaacaacgaaaccaaatcccctggctctacctgttgtccgatccttcattatcactgcttccacaacttccccataagtactgaaatactccctgagtcgctcttcatttgtgtcccatgatatcccaccgatgaataacttgccattatctgattgcattttatctacaagcaaaagacacgcctcgtccaattagcatttgagttcaaaaacttagaaatgcaagtggcagcagcgtcattagaaatggacaaagccaaccttctaaagcacctaaccatagggtataagaaaaaggcgtgttcctgatggatccaatccaattccttacatatatctataggctatagcaaaattttatttcatttttttaatgactcatagaaaacaagataaaaacaaaatcctggtgtgggatgaaatgcgcacaaatccgggtaggataaaatcaaaaacatgatagcattatcatttaacaaaatgttgaaatacaaatagtccctagcacgaccaaaaaaaaaaaaaaaaaaagcattacaagcaataccataaattaagacaaactgagagactgtattaacgatgcaaaaatagatattgtcggaatcagttacgaaacaacggatccttcatcaacaatcatcaagcagtgaatcaatgaagggaaagcactcctggagaaaacccacaaaaagtttcaagaatcaaagatccaaaggcggacccaattgaacaaagatcaaaacttcaatcaagattccgtcgaaacccaccgattgaagacgagatctgaggggaggcacaatgagattaagaacagagggcaggttcaatatctggctatgcctccccacccttttttttttcttcttttttttcaattattaatttgattaccaaatgcaaattcagttgtcaaaccgattgcaaaattttatgaagaaatcaaaagtacggagagagaaagagagaaacacatcggaagaagtttgtaaggagaaagccgagacgagaaagaagctgcgagatgtggtatgaccattatatagtgcctctgcaaatggaagatgatgattttctttcttcccttttttctatttttcttttttctttccctattattattttttttaccagtttgatttcaaattagtgaagaataaaaatgggaatctagtttttttgcttcttatttttacctgctagttttaaataaaaatcatgttcaaataatttctgagatcattaccaaaaaaataatttctgagatcgttgttcttttgtctgattgttttttgaatttacttagttgcatttattatctaaatctgtatacatcagtaagtattaaaacaattcaattttaatttatataacaatgtactgaaatgggatattaaaaaaaagtcctgtaaattttaaaataaagaatataatgactcataataaaaattaagacatttataatcaagatttgatagtttaaatttatatcataaagatttataagattaaaagtaatttatgaaaatataaaacttgaaaggaaagagaatataatgacttataataaaaattaagacttttataatcgagattttgatagtttaaatttagatcattatgaggatttataagattaaaagtaatttatgaatataaaatttgaaaagatcttatggatttttaacaaatgtttaagattataagagtcaatgaataatataacaaaacaaatataagattttaataaataaaaaattaaacaaatatgattttttaattttttatgtgaatcaatatatttttagaccaaaagtcaatgactaatttttttttgaggtattaagatcctttacataatgaatatctctcaaaagatatttttcatacataaaagttaggaaccaaaccattatcacattgaaataaaattatctaccaatcacatctttaataattaattataattcttttttctttgttgtttctttcttgtgactcccaatttgaattaataatcaagttatttcaaaggagtagttactagttatcatatcaatcaagaaatttaatatcacaagaatacctattaagctaatcaagtaatattttgtaaatatttgtaaataatattattctaaatgataggaagaaagaaatgatcaataattgtattgtcttcagctaaaggaaaatatataatgtgtaatcggagaaagtatggaaaagtctaaagagttcaaatagattattagatgagtgtaacattcaatatcataatatttatactacttgaaaatcttgactaaatactataatatttctttatcataaaaggtcttctaaaatcatttaaaaacacaatcaaatacactcccttttaattgcatttcaatgttcttatgcttttatctttcttttatgatttttatttttccttttttgtgcattcattttcttcttactttattggtgtttatcaacgacaggttatcgacgatcacaaatcctaaaattggaaaatctttggtattgaccaatgataaaatgtattaaaatttgcccatggttgcaaatcataaaaatgaaaaatctttagtattgaccaatggttaaatgtattaaatatgattaagtaaattacttaggttctatttaaataaagttctaaaaaaatatttatagaaaaaataagaaagtaaaatgaattgagttattcctataaactaaaatcaatatgtgtacactttagttttcaaagtagttaaatgaaaatgttactataaaagttaaatgcaccactaactttaatattttttatcgactatgggactaattctcattttgtagtttagttaattcaaagctcattgtccctcccaaaaaatgtattatgtgggaaatacttattttcttatcctgtaaatatttatagcaaaatccaaataagaccttaaaaaaatattaaatcagtaggacattggtccaattgataataaaataaaataaaaatattttttataattagaaattatatgaaatttattattatgcaaacattttagtacgtttattagaccaaatttaaatcatactttacttttatttcttcaagcttaaattttgtattcacttaaatgtatcaggtaacttattaggtcaaagttggtttgttaacttcaagaaaaattcaaatatccataatataaggcttctttttaattattgttttcttatttaatgtgtttttattttcttctacttttattttacaacatgatttttttcatccttcttttttatgtgcaatgtgtttttttctttatttgtgttgactgtcaatcaaaaaagataaagaaaaacaaaatctcttaatactaacaaatagtaaaatgtattaaatttgatgtttttttttttttttacaataatcacactaagatttgatcctataacctcaactcatgcatattattccaaactctcatataggccaaccttcgtggttcttaatgagttaattcacttactcaaaatatattgaataaataagtcatcgatcaaattgcataataaaaatatatataaatgttttacgattaaatttttatattaaaattattaacatgtatgtatcttaaattaatactaaattttaacttttaaaaaattaatactaaatttgaatcatattttttatgcttaaatttgttattcactcaaatatatcaagtaacatattatatcaaacttggtttattagtctttaaagacaaactctaatatacaaaaaatatctcaaaggattgttttttacttttgttttcttattaaatgcattttcattttctttccctttcatctagcaacaagataatttttcttttctttttgtacgcattcatttttattttttttattttttttactgccattgagtggcaaacataaaaatggaaaatgtttgatattaactaatgttgaaatgtattaaatttgattaagccattagttctaagttctttttggataaacttcttgatcaacatgaaaacaaggtaaaatggattgaatttcttttgtcaactacaatcaacttacatactttatttttaaaaaaatttagaccagaggatctctataaaagttaaatacataagataattttatcttaagtctcattcattttatatttttgtatttacttatccttcatagaatcttttaagattgattcccttctcttttttttttcttccttttttttcccttcctttttttcaacctcctcgtatctattaatgagttcatctactaccgaccccaattattttgggttaaagatgttgttgatgtaaatgtttatgatgttgacttatcctttatagataaatttatctaaataagattggtcaaaatattgatttagtaagtcaaatgttgcattgtataataaaatatcaaataaaatatttttataattaaaattttgtataatatttttatatcaaatattttagtgtagaccaaatttaaatcataagtaactttatttctttaagcttaaattttttattcattcaaaggtattaagtaactaagtagatcaaagatgatttattagcttaaagaaaattctaatgtccttaatataaggatttttttgtatgtaacctagaaaataaggattcttgttttactattgttttattattgaatacatttttattttattctacttttatcttgcgacaacatgacttttttttcatttttattttctccaatcaatcatttttcttcttctttctttcattgtttgcattgacaatcaatcacaataaaaaaatattctattggtaccagcaaaaatattgaatcatgctttttaagcttaatttttttattcattcaaatatatcaagtaacttttttgatcaaagttctttctctccaccttcctttcttcttctcaactctcttttttctttgttcatagttatttctttctccttcttttttttttttgaaacttcaatgaaggttttcatgccattttttgtgaagtcttaccattcttaagcaaggtgctgtggaaaaaccatctcgcacatccaccaaccaccacaaggtttcttccctgcatccaccaaccaccatgaagtcttttttctagtgtacaccaacaaccataggtctcctctcgacattccatttcccttcgcgtgacctcttctcttgaaactgacataacccacccgcgtaatccgtcaaccgtgttacttgaattcgacaaatttcgaaggtccaaacggttggttgcggttcaacatttgaagtggttgaatttcaacattttaagcattttctgcccgaacccaatcgtgaccaaccgttgcttacccctaatttggaatgaaggaaattttaatcgttctaaataatcaaacaagactataaataataaatattaagatttttttgaatttttatctaatagataaagtgtagaaaatgtacatatcaaatatggagaaaatgtttattgttaaattaatttcttcctggaactcattaacatttaatcaattttacacttcaaaaattaacatcaatccatgaatcagttcataagtacactcaaacttgcattccttgtgtgaaagagcctaattgtccttgtaaaacattaatactttagatgacttaattaaggtacttgctttgagattcaggatcttaagatgactaataaaccatgccttgttcctagcaataaggttcattaggtgttcaactttagttcaaggtttaaagagtgttttccaatacgaatgaaattaaacatcaaaatataaatgatcaaatcatacaaagctttaagcatggaataagaactaatattgaagtgcaaaatcaaattaagttataaatagtacataagagtcaacttagttacatccaaccccaacaaggatgagtttagctcctcttagacacatgtagagccaaaaatgagtaagaaatgaagaagatggatgaaggagtcatgagagagctttcaactaccatacaacatccaaggcaagtccatgtgagaattaggtcaaagtgttttgttaagagacacattatttctcatcttgttctcattaagtgacatgtcatcgtgtttcatttagcaatataaatattacatctatagaagtattctttttaggaagtacttgctaagcgagttttgatcaagctatttaaaattttctgttcactacaagaaacatgcatatttatgaaatgccttttcatcttctgcttttatcatgcaataacatgatttttttttattttgcttttttaatccattcatttttcttctcctttccgtaaaatgaataattaaatatgtattaattatttaaatttaatatgttaagaaaaatgcataatccattaattaaattaaatataaacacactcttacagtcttactcattttaaaaaatgttaaaacgagaagagtcttatccaaattacatatacatcaagctcagcatgcatgttggaaaagactacgacaacgtggtgaaggataaaacgaattaacagtggagtttgataatttgagaatagtgcaaaaaaaaaaaaaaattatagtgaaatgttgttggtaaccttaaactcgaagaagtagatgatgggatggacatatataacgatgcagcagaaatggtagatattgatatggcggtggtaaatttaattattgaacagagttgggtcggagcacgatcctgtgtcacgtggaggatgaaggaaaacacatgtacacttttctcaagtgtttttagtattaattcttaattaaaattcaaaattcatttccataattagtattcactttttaatattaccaatggatcttggttgaggcttgttccatttttacgaataaaaaaactttaatattgacttttagtatttattttttatacactatcatgtaaaaaaaatattgttagtcaattaaaattactctaaataaatttattaaagtaattattataaaattattggctaaaatgggagctctatctcaagatcgtctcacgatttctgattttcctccatcagaaatcaccacgttattgttagctgatttagtgggagtagctttcacaaggatgtagttttttatttttaataatttgtgctcctttttccttttactacaaaaaaaaaataactcaataatcttactgtacatgataatttattattaaataaaatatcaattttttatactatcaatatattttaattattagatgaatataaaatcaattttaatatttttttaaattcaattttaatgttttaaaattcaataactaaaaataaatttatattataattttaaaatataattgttatattaaacgttcacttatgaaaaattaattatataaaattaaatatttattgagtacagtgtataagttaaaatgctagttaaattttaaaaatattgtaagtaatttgggtagaataattaacattatttcttctcaatttccagttttcaataaccattacctctttttttttttttttccctttccttttcattcctttattaacgtgactagtgagacataaaataccaacaaagaaaaaagtgaggcataaattaagaaaacccaaacaagtactattttcttatgctagctggagacattaaaagttttttgaactatataataaaaaggaacttaatccgaatatgttccctcccaaatgaaacagatttttaagataaaataaaatttatcctttactcaaaataaaataaaatgatattttcccctattgaaaaaaaaaaatgacttgatttttttaaaacagaaaatgaagtgatttaaataatatgttttacctgcctcgttttttcattatattatttgggatatatataatgagaacaacatttatattaaaagtatgagaattataaatattgatcataccaccatacaaaaacaattaagataaaaaatttgtataaaataattcaaatgttaatagttacatgacatttaaaaggatacatgcgtttattatttaatcgttaaccatttaggtaagacttaatgatacatattcattattttgatttcccaaataattataatattcagtcaaaaaaataattataatattctcacctgagccgtttttcagttatcttgtgaaaaaaatatggcaatgataaaatctagcaaagatacaagatatatgcattaaatttccttgctttgcattgccaaatctgttgtcatttagaaaaggctaaataatatgctcttagttctttacgttatctataatatttaatttagttatttatttttttaaaaagtttaatgtaatcatttacgtttttaaaatgagtttaaacgatttttttttaaataatgatcttttatttattttaggacatgatttaattttttttaactaattggagacttaaaatttgtctcgttaaattaacttccatgaaattatgaaacacaattgatccaactgaatataatctaaaacataaacaatgtatatttcagcttcgagaaagaagaaaaaaaaggacaataaaggcagtgcgaacgttcccctgcaattgtctagttgactttcttgtaatacaaaaggatgatatttttgtagagtgaaaagatgatatcatttcatatatgctaatcacagttcacacgtcataaggatttttttttcgcctatagattcaaaagataataagttgcagtgatcaaaataaacggtggccaccaattgagattataatatttgtaaggaggacttaacctgtaaatcacaaggaatctgtctcgtacaccaagaatataagaatatctaataaacaaaaaaagaaattgagattaccttaaagcgagaaaactcacaaaaagtattcagcattaaaaaaaatgcgtagaatgtagcctttatttgtttgatgcctgtgttttcggttcaattatgaagcttgcaaggtggaacaatagaaaggaactattcttccaaaagttacaagtccatcattggttacccttgccatcgactgacatgttagagagatagcattgactatataattaagggtaaggaggtccgacttaagggtaatattatataacaaaaaaaatctcaaaaagggattaataaattggttgggccaaatatgggagttactgaaagtacactatgaatgaagtttggtgtttttaactttttggctataatgcagtaattaatgcaccgtttcataatgaagtgatatttatggttctataatgtttacccattgtactctaactacgagtgttttctattcagttatgctaatttagctttgtttatgaactgtgcagataagtcactgtgaatcttagtaaacaaatgctcatcttactggtgggtgattaaaccattcaggagaagcttttggttcagtgcttcacatcacaccaattgttgatactgtaactaagttgacagccagtagtgaattatgttacaaatgtgccttctttactttgaggaagacaaaaagacagacaaaactgattagtgggttgatgtctgcatgcctgtcaatgtcagccaccatcactatgccattgtccaagatgcaaatcatgcaatggagctgcaagttttgtggaatttcacatggcctagttatatatatatttatatatatatatatatatatatatatatatataatagcagagtttcttcatgatcctatcatgtcaagttaaaccaatagtgttttgtactcaaatatgacaagttgaagccatctgaaccccaatcttttttgtcagctcttcaatgttcaatatctacaaccttatcctttatataattttaatggacatatatgttatgaatgttaatgaagtatattagcctattaaatggccattaacattttctttcttttgttccttttcattctttctttctctcaccccctcttttcctgtttacttattattttcaatgaaatgtgataaaaggaaaaagagaattgagtctccaactctacgtggttctatttgtatccatattcatacacatcaatagtaaagttcttatgctacaattacttggacaattgactaggagttcccggttttctcttcagtttccgacttccagacaaagttatgcggcgaaagaccttgagtagcctgtttgcataccttctttgtgaagcaaagtttacagaactgatgcaactagtcgcttgtccaattgggttgctccttttgctcagtgatcgagtttctaagccacacggcttcatcttctggcttttgatcaaatttggttctgcttttgtaacaatgttgtgcaatttaaggctttttttcaaggacatgagttcttgttcaagattttggattctgaagcttgttgactcatattccgtagttgagaacttgaaattctgcatcacattgtctttctgcagcaggaagctcaatggcctgctactgagctcaggtccatcagtggatgggctctttcctagattctgacttgcagaatatggatacctagagcttgataggcttcctgacatgtctccacaatgtgcatatctaaatgaatctgagcattctttgaaggctttgtgtgtattgagttgttgaacaaaaagtgcttggacaattagacgtagaggcatcaattcgtcttgaacagcttcaatgcatgcctcttgtgataacctttgacagtccagatacttgcacacggctcccttatcatcttgggaaatacctgaatgtgtctacaataaataaataaaaagaaagaaaaaagcgaaatatgttaaagctgaaattgtattgttcttttttaatgattggtctttgacataagttgggaaatgagctatgatcaacttttgctaagcttgtaaatagtatttactcattatttctcttattctaaggaccatgattattgtatcattcttgttaattattcagttagaccactaggtagaatgctgaacattcattatagtgttcagttcctaaacggatagtattattggcatgagagcatgtgtaatcaactaatgtagtttaattgatgagtcctactttttaagaagcttttgaggaatgctgaatgcttgcttaccttgagaaagctgttgattgttttgtaaagggggtaatgattctgtctataagatggtggtaccctttcaatgagttccatgaatctctttggtcccatatctggatctgcagctattttgaataaatatgcatcccacaactccgcaaccctgtaattgctagcttctggggtatggtttacacgtgagctagatgctacatatgctgaaattatgctttccatagtcaccaactccatgctagaggacattaactctgctccactttctggaagaagaaaatcctccacttgagaaaagtgcaaaagtgatgtaatttggtcttgtaactttgccttgctttcagtcctcaaccccaactcaagagatctagaaagcaaggcaaaataaaaccccactggaatcactttcctagccttatcacccactggaagaagatcaacaacaccttgtagaatcacagaagctttgctattcatgccaccctccccaatcttgtcacaggaactctcccaaaattgacgcgtctttttagagagcacccatttgtttgcatagaaaacaatgatgggactcacatacttctccttcattccttgtttcctcaaagaccctataacccttttgaaaaagccaaagggtagagcaatcagatccctcatccacgggtcttggctcacagcatcatccttcattatttcacagctccaatctttggaagccaactcttccactgtcacaacaggagtgtctctccttctttctggatcaagcacctccatgcatgccatgaaggcaagagattcaatgcagcgactcactattaacagatcttcagaccaaggaagcagcatctggcacctttgaagtgcaataagggtgtcatcccaactttgcaacacaacttgattcagataaagatcaaaccgttcacaaaggttgcccgaacagtgatcttcagtcatttcaagaaactctgctgcacacctaagggccacaacgttaaaagggtcaatcaatgtggaggatccataaacgaacatggcaatcatctcaaaggtttctggtcctccagggaatgtttccggaagctcaacctcagacgcattgtttaacctcttcttgaagtatccactctttgaagtcaaaggaaactgcaataaacacaaaatgcaaatcaataattaaggtagttactggtaagctatgtgaaacattcttggattccaattgtgtctaaacttactttatgcaggttgaatatcttgtctttaactcgaacacggacagaaacaggtaaacctgtttgttggctcctgtgacaaaatatcgaagtgcatgagataaacttcggacatataaccacacgtggaaatggaatgaatgatcaatgacatgtatatattaccatgtgatgaccttgatcttgagcaaggctccaatgttaggtgaagagtaaggactagaagcaacagaataatcttttggactcacaacctccatgttagtgctacttctgacaatggaaggatgctacttattctaactgtgactaaacgaatgcatatgattctgaatccttatctggtaaggaattaactagagcagcagagttctgatgttaaagaaagaaaagtagtgtggtgaagtgagatttgaggagtttgtccccaacatattcttgctggatttgtactattattcaccttgcagtagtcaaagtcaacatgcacacgagtgaaactcgaactccaaactttaaggcttcaaaaacgttctcgaatgttgggtacttgaattcttgggctacaacttggcggcctcggccaatagaatagggtgacttttcatgcatcctaacatctcaatattgcactttaagtttgtgtatgtacaaccataaaaccctactcctaaaattcatgagtattatgttaaccagccatcaaattaattagttaatacttagtggatgaatcaattggtatgaaactatttcagtttgataaattatttcgaattttagttttatatatgtaactatattaaatattatttaaagaaaaaatattgacacttataatgatattttttttttgtcattgaaaatcaaataaagtataggagatttataacacttacatatatatcttatttaattaagagaattagacccccttagttctacaattgtattactaaactaacataggatacccaataacctatactagaaaattagttaatattttattaaatatttttaattatttaaaaatatgtgttttgcatttttaacttttttttttgtttatttgcttaattagtgtcattgtaataattttagtcttttagtataacgtatccaacggctgaaactttcagtctcgattgtctttgtcaacgtatagggccttaattgatggctgatgaggcatttggggaaatgatgggaccaaacagtttacacaaagttacgttggatttggtttaggttttcataaaagaacaatttgggtgtattgggaaaaaagaaatgcaagggtatgaaatgaaataaataggcaattgaggaaatgataggattaaaatattgcaaaggaaaagaagatggtgaagtgcatgtgaagttttgtggttcctttatgtgccgtatgcctaacgcccaagacggcacggctactcaaattggggtgctttggttattgggttttgcttcctttcaaccacggacccctggatccaatattttacttttccccactctttgaaaagtacatgatgcgttgcaaaattgaatttctttttttggattttatcttatttagtaatagcatgatttatgttgtgtttataaatttatatttatattgtagaatatttgagtaaacatgtaattctaaaatttgtaaagtccattgtagcctttcttcatgattcttgatcgtttacatatatgtgtgcattctcatttttcagatacatgttcaatgattaaacatacgatacgacttctacttagactggttaatatctctcagtgattgaagattttgattgtttctgtcaagtgggttaataatgtacttatcttccacttgtttggttaaatatattggtttgcatttgttatgtggttaaacaatgattgtgacttctacttagtagttgagctttccttagttgtcattattgttcacttgtgtatttgcttatatatgagttcaacatcttctcaattcctaaattgtttttttaagaaaaatgtgaattttattaaactattatttattattgcaagtcacgaaagagatacataagtacgagatacaatttttttaaaaaaaatgatgcacgaaattaacaatcttcctagacccttatacatccattatagaagggaaagtttctatacatcacaagactccaccgacagggaaacaatgagcaccaacaattatgatatcgaattcagacaaagcaaggggttagaaatccattcaaaaaaaggaaaaggatgctcgtggcttcttagcacctgttgtatacacggttctgcctctctaaaaattacatgattcctatgagttcagatagaccatagaacaggcatccaaattcccatccagcacaaatggtccatattccctctacaaagcccatggtgactccaaaggtaagcaacacagattgtagggagagcttgttgtaggccaagccagccataacagctttgccacaccttgtatgagaaggagtaagaaaaaacaaatgaaatgcagattcagtctcagcattacacagtttacataacaatccttcctcagccacacctatattccttctcaacaaagcttccttggattgaattttgtctagtgtcacacgccacctaaacacaagcacctttgatggtgcttttaccttccacaaagcattaaaaaaacttgagtggtcatcaatcatcaagttttgaattagtgtatatgctccctttatcgaatatccctccgagggtaatactctccacaccaccagtccttttcggtttccaaatttgtaatagctgcagcagttcttcttccatagggatttcccattccataaagggaccaggaccaaaccacttacacaaaagagctttgttgaatgtttatataagcagacaatcaaagagattggtctgtaatcccccagaccttgtggagtctcctttttggggatgagcgcaagaaatgacgcattagcaccaactgaaaagcgaccatatctacagaattctgccatgaccctcataatgtccgagttaagagtatcccggaagtgcctaacgaatttgaaaataaatccgtcaggacccaggcttttgctcccctcacagtcccaaatcgctgccttgacttcctctttcgaaaagcttgcaatcagaccaacactatatttgatcatcaagtgttggaacctatcatatgaagacaaataactattatacctctccttaacaaagtctttgaaccctataaccatccattctccttaacaaagtctttgcagatttgaggtgaactcaccattctcccctctcttctttcttccgtccttcttactgcgttattttggtttgtattatttatctcatgccgtaaatgttaataaacaactaccaacttgggagggtgttggatatatatagctagaattagaaagttgttagttgggttaaaatgatgatttagattagttactatctcatccttgcatataaatgcaactagaaagtgacccgtagatagagaaaatgagaaagagattgaataaaaataaatgagctcatacacaaaatggggatacaaggcgatgcttgcatggtttttatagtgcaaagtgcaaaccaatgatttacttgtaattgatatattttaattctaacatttttcttgtactcgagaaatacttgaattaccttatgcataattatcatacaaaaaataaacagttaactaaattagtaaaagaaagttacaatcaatcaaagtagtaaaagttcaatcctttataacgcagaaaaaaaaaaaagtctcaacatagatgtttcttaatcaccatcctaagactagaaatcacatgcctctcacgagtcttctagttaaatgaagggaatcttgtgttctctaaattaaacaaaaaacaaaagttacatatatacatttttatattattagttattaattacttttataattaattttgtcaaatacttttaattcaataagtttatttataaattttcagctttaaactagattttaattttaaattagctaataagatggttttgccaaacataataactaacaaagttttcttttcgtacattttagtaattaaactctaactgtaacataatttatcaccaatattttacatatatttttgcagaagctacccatcattttattataatttcttaatgacattcggcttccggattttgcgatacgtaaccttctattaaaaaaatatgtatcgtttttgcacgtgtgattcttatgctgtacgttttttataccgtaatggctttttttattttttataattgagtcttacatcaagaggctggctacaaaatccacaggaatttgatgcagctctattagttttctattcgtagaattcaagtaatcatttatcgaagttgccaatacatatgcagatgtggaatttctaataggattattaccgacttaccgtcacgcatttttttttgtgagcatttatggtcatgcatttactgtattatctgttatattttcatttcattttttcttcttgtctctttagagcatgtttgattaacggttcaaaaattatttttgggtgctaagcttacttttgaagaataactcagtttcataatatgtttgattagtttcaaaaatatgattgcattaaaattttgcttagaaattaagttttgtaataacaagctaagacttgacttgagttgtttctgtaaacttaaatttaactcaaatttaatcttacaaattttaatcgaaatataacttacttattttttttctattgtatgcgtttgatacatttttctccattttttttttatctctcttctttcttctttctgtttatacactctattttttagatatatgtttgataatatttatatttttttatattggttatataatatttatatcctcattgatataaatataaaataatctctctatttgtaagtttggtacttctggtatcgatcgatttccattaatacaactgctttgatgattttataaaagaaaaatacgtttgatatttttcttttctaatatagtaatatacatctcttagacagtgaaccattgacacgccgcctaaggaaggctttatcatttgcatttgcaactagtaaactaccaaggaatacgaatatgatgctgttgccaaatctttgtagcagatttgtgcttcttaatgtcaacactgcgaaattctcttaattttttgttttttaatggagggatctttaaatttaaagaagaaaaaaagcatgctttgaatactgtagaggttactaatatatgtcttctcttctcttgtttttacttttttttctttttctttttaaagctcacttatttcattggaaaatgaaaatttcaaacaattcatctacttatagcaaaattagggataacagcaatcaaacgcgagtttgcttactttcagtcttgtccctcaaaaggcgggacaagttcgttttgagtttataaaagatgaggtgaaaaatgaaattcaatcctattcttccctagattttatcatgttcaaaaaaaattataaaaaatctatctcacattttttttaaattatttgttcatatactttaaataaattataaattaaattattaattacatttcaattcaatatatatatatatatatataatttaataaaaaataaataacataaacatatttaagttaaattatattttaattaaatgtataattttaaattttattataattagtattataattataatattatttatttaactattaaaataattattctatattttaataattataaaaataaaacatgaaataattatataattaacaattacatataatatataattatagaattatatataaatatgtaactacactattaataattataaaaatataagtaatattcctaatcccacttccttgggaaatccgaactctacctgggtcccaattaatatgggtttttcacgtaaaactcatggcggagtcgaatagatataggttggatttttattgacatacctaagcaaaatgcaactatttgaaaagatggatttattagttgttgaatacacaaagaaagagcgttcgtatattttctaattcatagcaatatgattgtagaacataactaatgtaatacaaactttgatttaagtttttgtaagaaaaaaacttttatttcagtgtattttcatacaagaaatatcactaacacgttatattatataatctgataaaaaaaatcatataatatttttaaaaactcaatattattatctgaaattttttaactaattaatgaaatgaagtgatgatgagtttaattaacttctaatttaataccaacatatgtgacttggaattggcggaatgaactcattcttcacaatgtgacaaactaaaatttaaatcctcgttaagagaaatgactacatttaatttttcatcatgtcttaagtataatgcttttgaaaaaggatattgtgagaaaaaagcttataatttaataacttttactcataaatttatgagttttaatttcagtaaataatttattaaaaagtatgattttacttttctttctatatttttatgctttttatttattatttaattcatcaaatactcgttgaaatttgtagagcctattttatatgtagtattgctgctgcttagttcaaaggaaataatgtctcgatttatttaacgagtaaagtagaagttattcatttcaggaaatgataaataaggagcaagcaggagctagagaaaacgaataaaaatgatatatttttgataagtttattatggttatagaaaacgaatatacttttttattttattttataaaaatgggctacatataagtaacaaatacttctatccaaaatgacaaaataaatgattgtgattctagacatgattagaaaatatgacatgattgattagtttgctatgtaaatttaaagaaaagtttttcacctattaaatggcgtagtttaattttaaaaaagtatataaaagatagaaacaatattattattaaaatatgatgaaattgtgcatttaagaaagtttttctttcttgtcatattttctattaaatctcacatgttttcaagatgaatacacttctcaaaattcaactgaaaatgaaaccatgaattacttgctaattaagaaaactgtcattaacctataatcttaaatcaacctatatatatatctatagaacgaccatccattataacttattcatcctaatatcgcggaccaaaaacaaaacttattcatcctatcacatgttagtttttagttttggggcttaaaaaacatagtatgctaacctgtttggtctattgggtcgggtcaatttgaccttgttgtttctgaacctcaaaataaaaagcccatcggcctaacccattgggccgggctaattttgaaagctcactttaggtggacagataagaatgtagttgcagagataagcatctaaatttgatagttaatcttaagcttgttggtttcagctcaagagatgatgcaaccaattttaaggaagccctcccaagtcctaacggtttcactgttgaagcaagtaaaacagaatatgccagaaataaatgagggaagcagctggaaaacaagtggattggcattttctccaaacagtgtcatctattgttcagtccactgcggaagttatgtacatcactgatatagtgaaactggagtgaaatgcatgtactgaccaacaattagttgtggcctgtgggatacgaatatacttggaacttggaagtaaaaagtagttggacataagggtcaaacaatgaactctgaatacgtgtgaatgaaggtattcaattgattggcgttgattcttcatcattgttgagttcataaaagaaaggatcctcaaggagatctgtggctgaaggtcttgcccttggctgtgctatgcacttctcaatgaattccttcacctcaggatctgtgactttgctcaaggcctcaggcttgattcccatcgtgacctttttgtatatctcggccacaccgtcacattcactgtagggtatttccattgttaccatttccagcaaacacattccaaaagagtatatgtccaccatctcagtgtaatcttcctcgtacagttcgggtgccatgtactctggtgtccctaagattgaatgtgctgcatggttacgtcccactattgcagccaatccaagatcaccaattttcacctacaaaatgccaaggtcaaaaatcaagggtctatttatttccattcacttttttggttttataaactgttttctaaaacaattccacattatttagtaatccacttctcatccaaattttgaaaattatttccaaattaccagaaagcagaaataattaagagatgtttttcaaactcttcttcaattctacactctctttttgccttgcatcaccctccatcaactatatgagtgaccttgtttaattccattttcgaaaactaaaaacaaattttggaaatagtaactaaatacaccttaagttttcaaaatgcaacctagcaatgcaaaacatagcttatgcataagcaaatttgtaatttgtagaagctctcttctcttagcttctccaacaactgatttttaggttatgcataactgcataagctaattcatcgtgtaacaaaactgcattttctttgaaccacctaatcattgcttaaaaagaagagaactgcatatatatgttggcatgactgtgttttcgtttcttcatcaatcatcaatagcatgagaaatactaattaataaaaacaaagcaattattaacctggccaatgttgccgttgacaaagatgttgctgcaattgaggtccctgtgaatgatgcaggggtcatgcgtatgaagatactccaatcccttaaggacctgtttggaccatttcttgaaggccttaatggagacgtggcggtgcttcttgcggtaatccctgaggttcccggaggtgcagacctcagtgatgaaattgatattgtggcgctcctcgtccttccacacgctgtaacagacgatgatgtacttgttgctgagggttctgagcaactcaacttcagagtgaaggcgattgatgagagcagtgtcttcgctgaagttcctcagccgaacctgattccacgccacctcgattccttcctcctgatcaaacgctctgtataccttcttcactgctccgcaaccaagaagatccctgtaacgcccgaacctccccgttggatcaacctccacgaacgcttccacttcgctatcgcaactgttcgacttctctgcaggcattttcaatctctctctctggtggtaaaaggagaaggaaggaagggaaaaggtggtgaattcgattacctcgctaacaactaacagcttaactaaactaactgaaaaggaatttatgaaactgaattaatatattactgattactcgttcaataattttctataaccctactttttcgctctgtgtcggttcattatcacatcaatgatcttaacttgtagtatttttttttgtccaatttctgatatgattgtgcatgaagcagcaagtacaatagtgaaaatctatgcgtaagaagaaaagcttattaccttaacaggtggcgaacggagattgggaatctgagacctcaaatatttgagaccctacgcggaagtgtagagaataaataagcaagggaagggaagggagattgagttgttgaatgagatggcaaatgttgaggtacacacacaatctccttttccgtttacttttttttagtttttaactttgtgttaaaaatcaatatatatatatatatatatatatacatgaattgaaataataattcttcattcattttcattcattttattcattcctctcttctttctttcatatattttcccttaacatgaggtttttatatatataagagcaattcaacaacatcctaataatacggaataataacaaactgatctaatcttaatttttatttgaatataataataaaaaaatgtaacaacctaacaaattataataataacttgaaatttaaataatacaattcaacactcccctcaagttggtgcatgaatatcggtcatgctcaacttgtcaattgcttcttcaaacactctttaaggaatgactttaatcagcaatagtttcaagaagtgcttcaagatagttcacaatgtgcttcggttatgtgaggtagaaagaaaattgagatacggaaagagattcggaacaataacatgttcatgtcaatagacttcagggatggtctgtgaaggattcagaacaatgcaacgagcttcacatcaatgaccttcaaatggaatacgtgcatggagaattgaaatacgagaaaggattcggaacaatcacatgatcatgtcaatagacttcagggttggtatgtgaatgattcaaaacaatgcaactgacttcacatcaatgaccttcaaatggatacaagaatgattcaaaatggaaccaaaatcgcaaaggttatgcaaggcaaaaatgaaattcatgataataataatcataatttgtaaaggaatcggaaaaggtgaaggttaaggaggagatagatggttggatataagtgaaatacattgaagataagataaaaagatagaaggagatgtacgtttgggattgtgaagaagaaagactctgaacaaataaggcatcggaaatatggtggatatcatgattctcattcatggaggaaaccatgattttttttcatggaggatatcataactctcattcatggagggaaccatggctctgataccatgttaaaaatcagatatgcatatattggaataataattcttcattcatttcattcatttctcccttctctctttcatatattttcgctcaacatgagatttttacatatataagagcaattcaacaacatcctaataatacggaataataagatctaattttaattcctatttaaatataataataaaaaaattgtaacaacctaacaaatcctaataataatttgaaatttaaattatacaattcaacactttgtagtaatacatttgagatccttgccatgacgcaaaattgtaatgtaatgggaatcattggatctggattctgaacttgtttgttacgttcacgggaagaatggcaaaacatttaagtttcaggcaaagcccgtacccatgctcaaccaccattaccaacagtctctcttactgtattatctgaaatctgaattttccaatattttcttcaacaaccccaccccttaatcatgatacttccaattaaataccattttccctatgcaaagtgtacaaaaactactggtgtaatcttcagcgattctgttttttcaattattcaaaagctggtttagttacgttattttcgttgtctcttcatgcatgagttatggcacgcggtacctgtacgttatggctctaataaaaggctatatttttggggggggcgggggggtgtcaattgacatgaaaattgcatcaatctgttcaacagctatatcaccttgatgacgacatgtctaattgtcaaatgctttaatctgaaacgtttagatccattgaaattcttctcctttttattatagtgcaacattgtagtcttgtgagtttatcagggcgtgcttgttaatacttttgaaagactacgcacccacaaacaacgtaaaaataaacaagcaactcagatgagttgatcaatagagcttatcttttcggcaacaataaccacaaacgagtaattgatttgtcaatggactacaccgtaggcctttcaacaacaccacctttttcatgatactttcaaataaactgctcgcaaataccattagtcctatgcgtactgtaactattggtgtagcctttagcaaaaattaaaaattggtgtgaatatgattattacgtcattatcgtttcattgttgattctgtggcatacccctgccggcgctgctattatatggctctaatatgatttatcagggatcaattgacaaagatgtacatcaacgtatttgacaagctacagcaacttgctgatgacgacatgtctaataggcaaatgcttcaattcgaaatatttagattcattgaaatcttgttctgtttctggtccatgttaccacaagtaatccccagtgaatgtcttgcgagtctctcatggtgtgtttaaagtttaatgcttttggaagactacaaccacaatcccgcaaactacatataaggataaatcaatggggactatcttttcagcaacaatgaccacgaccaagtaactgactggttcagtggaacacacctcaggcctctctcagaatcaatggctcccatgggtttctttaccaaacaaacttgtcccttcaccattgtaaaacacccctaatctaggacgtcttccccctactatggaaacacccttccctttgtactattaatcgtttattttatttggagcaagtaaatgcaattgaagaactgaaaagggatctgtacaatgtacatacatcacatgcaggctcaattcttgcacgactataacctttatctgataattactctaaaaggccataccataaaaataagcatcaaactgccattcactcagatgcatgtgagatttggctacatgaatggcaactgcaaaatgtatggtgaaaccagaaagaacctacttttttatgcaaaaaagaaacgtgaagaaactattcaataagaacaaaacctatcacatagacgcataaaaaatctctcaaataggcagaaaagtgagatagtaacttcgtagttaatccaatatacaacaatgcctttggcatagaggaattgactgaagaacttctagcaagaagattttgcacatagacaaccagtaatcgctgagcaaggctaaaactacaagaattaacaatctaagttgaggttacaaaattcagcaagcaaagtttattattattctcagattttttttctctccaaatttatatggcggtgcaactttaatacatcatcaagggggagggggagacatacagcatatcatggtttcaaaatatgttacaacatatcacaagggaggattggagccctctctaacagatggagacctggaagccaagctcccatcacgaccaaaccttgacacactcctactaacacttctaggagtagccaaagcaggagtagaaccacggtaacttgcccgaagtgtttcatcaacagaagatgaggacttggcaaacgcattcctcacaaacttctgagctgcaggagacagtgtacgcatgcttggactggcactcccccctctaaccggtgatgccaacgggggcttatgaaacatttttgacctctcccgtatcttgcgtgcagcctccctagaaagagaatgtgcctttgaatctcttgccggtgcagaaggaatcttataatgaggaccatcagcactaccaccaatatcaagtggcgtatcttccagatccaacctcagcggagtcccctcaatttctccccaagtaataaacggggattcatcaacacctggagcaggggacggtgtcttaacaaagctataaccattctcagctttcttcccagattctaaataaaacggatttggagtcttcctcaaatcatccaaatcatacttctttaacttatccccttctctaagagacataggcgccggcgtagtgccagcaactggcgcataaagcacctcaacagttccatcatcttttggcctagaatccatcattttaccatgaaacctagtgttcccgcgattgatctccttcgtggcggctttaattctattcgctctttcctcctcggtcaaagggacctcaccccgatcagcaggatgatacattaacaaattcttggcagtgtaattccacccttcaagggtactcggaggctgataagaggttccataaccatcagtaatcctatccctcttcacatcctcaataccctgcacatcctcattcaaatacccaaacctctctttcctcttcttattcactttctctagaatcttcgaaaaactatgattgtcctcactcgtgtacctcctcataaattgatcgaggccaagcgaagtatcagccccaccatcgttattctccccctctttagcctcgagaaccggggcacgggggctttgagagggttttccgtcgaactcatcgagaggtgtgaaatttctaacgaatgtggaaccgggtgtgtgggaggttgttctagaagtatcattgggattggttacctttgctgtgccggcgcggcgttcgaggatcttcaattgggcctcgcgaatgacaacagggtcgccggttttgatggcttcgagccagtcgaggcggtcgcggagcttggagatgtcggggaagtagtcgcgctcgatgatcttctccaacgcctcaacgtacgtgtcctcgtccagcaccgcagggtgcttcgcacacgatgatgatggtggatcgttagggttttgcgccgatacctgggaaattgaaggggacggcgacgagatgtggagcggcgagtgccctggagattgaagcattttctcagggtgaagagaaagattgattgattgaatttgtgtgatcaaaactcaaatctgtgagttagggttagggtttgatggggagaagattctctttcaggttcaacacgaaaacaaagcgagattggaacatggaacagattttctcccaaaccgtgttttttcgttttataaataagtatttatcttttttatcttcacaataaaagtaagtttttatataaaattttatttttttcctaaatacacgtttctttatataattaatattttaggtaattttttagttatttattttttaaaataaaataaagatagtgacgatctttaaccgtcatagtataaaattaattattttaaaagatttaatatcatttttgatctattatgtttcacagttattttactttgatatattaagttttaaaatttttattttggtcttttatgttttcgaaatatatcattatgttcatttttaaaatttaaaagttaacaaaatattaaggtttcgatgattttgttggtaaagttcaaagccgcagtatctatttcactcaggattgagtttctttattaggtgtttttttttttgcctgttatttcgggaggtattcaggtttggcatatgcatgcatgctctgaccaagatttttgggaatgattctgtactccaatttggtgaaggagctttacaatttgaaaacataaaaaattatgatgaaaattttaaaacttaatatatcaaaatgaaataattgtgaaacataataaattaaaagttacattaagaaaaaaaattaattgtgtaggtcaaataaaaaaagagagtatatttttatatgatatgataagcccaatggtgaatgtagctcagagtgagaaaaaaaagggaggcccaaatccaaattgtgggttaatagagaaaaaataagaaccaccgaacgaagacttgacaaatgaaatgaaagcacagaaaggcatattttgtgtgtgtttgtgtcagcgtgtcactttaaaattaataataaactgaggagagagagaggacttttgttcccctttgccttgatttttgggtcaaataaatgaggatgttacattggactctctcccattgcttccttccacccaaacccacaacatagacgacatcttctgcaacacaaccaaaataccctcccttgttttgtttactcaactcgcacttcctcttcaccaattttgaggtctcaattccgggtaagtaatgcttcccacgtgctatctttctccttttatatattccattcaatttcgcctacttcaattcttccttcttcttcttcttttttttaaattctccccttattttaatcttcatatactaaaatctgtgtgggtctttttttctttctaaccgaggtatgaactgttgtgggggtttggggatgcttccacagaaggtggaatagcattttttttttgagacctaagcaatgaaatcctccccctctctctctttcctctggatttggttcggctaatttcagatacaaattaaagaataagctatctctgtaactgttgtgtttgtaattaattggattattcaactagtaattaagacgttaagtactgtatggtaaaagtgatctcaaagtaggagctggatattgatttttgtttgagatttgagctcctttctatctgaaaattaattaacatggctttatgcatgtgtctgtttgtatatagtattgcgttaagactccgatttggaatatgtatgtagatattctatttggtccatcatggctgaaatggtttcacatgtttaaagtgagttttatcttgcggcttctactaataaaagtttggtttttttaagatcagctgttgagcgactaaaagtagaaagagagtttttacaataactacttttttattccaatataaactttccacattttgttccttagaacagggttgacattaacaaaactgctaaaagttcaataaaggaaccacgtatgaaaagaaaattttctcgacccacactattcatattcatgatattgctgtcacagggcaccgaaatttgtgttttgctaattgctttttaaacgtgtcagctttgaacagccacaagcacgcattgcttgttcaaggttcaagccattcatggaagcagttaatgaaactagacctgtttccttctgatatattagaaaaaggttcacatggtttctacagacaaaagtgcggatcaaaatatcccttctgatcaattgcagcagagagtgagtcctgatagtgatacgacattgtcacaaggtcatgatactaaaaatgatctgtccaaaccagaggaagcaacaagtattctttctattgtagttaaaaatgaagggaaggattctgatgctactgcttgtgccttggaatcagatcaagaaggaagcacatgctctttaccacttgggaaacctttgcagagccctgatactctttcgcatgaattgcctcgatcgcagtccagtcaggaatgtccctctataatacgtgaaaaggtatcaaaagatggctataactggcgaaaatatggtcagaaacatgttaaggggaatgaatttataaggagctattacaagtgtacacatccaaactgccaggcaaaaaaacaattgcagcagtcaaataatggacatatcacggattccatttgtatcggtcagcataatcatcctagacctcaattaaacacagtatcaattgagtgtgttctgcctgttgttgaacaagcacttcacaaaccctctctagccaatgtggaaggtgagcagtacactttgtctgtacttttgtttctatgcctctgtaggaaagatcttaatgtattttttgacatcatacatgaagacaaagcatccgttgagcatggatgtatgcctcaacagatcaagcctttacaatcctttcctcctgcaacagtttccccagttaatgagttgaaagctgcacatttacaattgactaaggcaaagaatctggttcatgataacaaggaacctgagtcaaagcggctgtacgttatatcactattttttaaaatttgtgttgatatatatatgcgatagctaacctttactgccaaattgataccaagcaggaagaaagacaatagtaatgctgatgtcactagagttgacatgtcaactcgggaatctcgtgttgttgttgttcagacttcaagtgaggttgatctggtaaatgacgggtatcgctggcgcaaatatgggcagaagctagttaaagggaatacaaacccaaggtacatgttaacttttcatttcaaaatgcagtcctattttctgctggtgttgtgtgtgttagaatgtgtttatattgatccatattatatcattctgccttggaagagctagcctgaagccctgtgagttgtgactataaattaatttcattagcttccagtctaaagatctgtttgagttattcttcgccttcttgaaaccaacaggaagtgattatagtatttccttttatatcattttcaaagtgtgtcccacatgcacgttttgtaggattataatctgtggctaatacttaagtccgcacaactaggtcacactttttatgggtttaacaatgatttagcagttctaaccaggtattgaaatgcaacccaaactcacaaatgtttgaacatagatgaacaattttattagaagtattgtgtttctttagcattttaaaaaagcaaggcaattgtatcaataatgcttttgttctgaactggtatattcactatattgggtatctgccaatgaccgattcctctggtctaacttcaacttcttcatctgctggttacatttgtcaagttgcctcttctcccactggttacactttttttagatgtttatttgctctctcagcccctctatgctgtgcttacatggatacagtgttcacaaatgttttaaattaatttgactgcattttctctccactcttccagaagttattatcgatgctcgaatcctggatgccctgtcaaaaagcatgtggaaagggcctctcatgattcaaaaactgtaataactacctatgagggacagcatgatcatgaaattccccctggacggactgtcactcagaatgcagctacaaatactcgcacaacggccactaatggcaagccaggaaccaaatctgagggtaatactgatgatacaggggacctaattggcgagtcgactactaagtcaaaggctggtgatatggttgagtttcgtgtgatcagcctttctaatgagggtcctgaaattaaattaagtgagcaacaacaaaaggataactcagctactaaagacgattctgtcagcaatgacgttatatgccattcaagttctggagttctgtgtagatcaaatgaacagctgaaaggtgaggtaaaacctatatcagaaggaagtaaggattgccttaaggtggttgccgttcatgatactcctagtacagaaagtgaatttaacaagcaatccgcagctgatgaagaaccggtccaaagctaaatttgcaatatttttgaaagggtcacctagttacagaagagtataaatatttgacaatgacataggctttacagatatactgtgggattataattcctatttcgactctaaccttcaactcttcttctagctctctgcttgtctttgggcaggttgactaaatatgcaaattacaattaatactacattggaggatatcataacttgtataccattattatttgagttaaataagatttacattttcgtacacatgtatctaatattctaatgtattgttgaacatactcagctatttgcatgtaattcttgttttgtgcctactaatgctttaatcttcctttcttccatgtaaatttacaaaatgcgttgcagaattgcagtaattgagtatagcaaaagttattccatatgttaaaatgtgtgattgttggtgcagtggtttagattcattctttaatgtaatgatcgatgctcgactaaatataacaggatattggattggtaatttattatttatccaagggtaaaataataaaaaaaaaaaaatctgggggttggagcctggaggtggttcatttagatagccactcctctcatactttgtccaagcaaacaggataaccaattggcgtcaaggttggaggctgagaattttatgggtccatatccattacgtttatgctcattcttggtgcagtctatgcttttgggagatagtgcgagggtctcttcttagacattatttgtttttggagttttacctctttttatattgaattaaaaataatagaaagacttgtaaaccagagaagaccttcctgaaaaatcgtctatatttttttgtgtcacgagttgggtactaaaaccataaggatagcttagaatctcttttctgttttacgcaattatcttattaggcactgctattattttgtcaaagtccacctttttaagtcacgttggaccatgtcaaattgcaagaaattctttcttccttccctcaccaatagacatgcaaatgttgaggtccaccgatgatgcaagtcacatcctaatttcaatggtataccactttcctgttagaagaaatttttttatggagaaggacacaagaattttccttaggagatataaggttgactcgatggttaaagaagggaagaggaagaggtggggggttcgaagacgccaactgcatttctaacaaaatcaataaattaatatttttcaataaaaaaaaaaaaaatgttctgtcaggttggtccaccagagcaacgaaacgatcccattgccacaaaccctcgagtacgcagacccagaatggaaggagtgattgtgccaagttaattctagtcccattgcctactcctcccccacagaataacgataaatttcaaagaatctgatacagctgtgtttcttttctttcagtaaattactagtaacttatctttcttaaatgaggccacgtgggttattttattaatttaatcttaacacttaaaagtaaaatatctatctatttcatctaataaagtgaatggacagcaatgttggaaccattgctaagaaaagccactctactaatattctaggaaatcactttccccagccactaataagccaaacattgagggaccagaaaagattttgaaatgaaagattaatattgctgataaagaaaaatgctacatacaatttcaattgaaattcttgaaacacagaaaatggacaattagattggatttaatgttgagacctttctcattaacttctacatagtaatggaacagaaaaagaagagggacatgttatgcttttgttccccctcgaacattgaggagtcacatattgcccagttctcatttccaagcgcaagaagcaaccaaatctctattcatccaacccagataaagagctccatctctctcttcaagtctatatctataactgtagttctcaagcaatttctttatggtaccattcaccaatgaactcaaagggtaaggagtgaaaccggccattgcaaatcttgacctccacttgccaagcacctcatgtcgttccaccctctcaaccccttcacaagctatgatgttaaccaagtctcttgccaaacaatgctgctcaacattgattctctctttatgctctctgggaagagtcacatctattgactcaaacattgctgtgtaatagttcagagtttcaaggaaacgcggaaagaatgcagcagtgttcgtgttagattcttgctcaacaagtgtcaccacctttggtgataggctcctaaccaacctcaacagcctatccctgtgattctgagtactcacactttcatccggcatgtaatgtaacatgaatgcaaaatttacagccagagcttcccctggtcgaactccaaggttatgtagttgaacatcacaacctgagatagctgcagcatgaaattcaaatggcaccttaaaatgctcagcaagctttgataacctccgtcccactatgtgtagtccaccgccgcgagcataagccgatgttgaatcatcaatacctgtaatccggatgtggggtggccctccaggtctagctgcaaaagcctgaattaaagttatccactggcttccttgaccaatttggaaatcaattatgtgaactctgtcttcatctttcatggcttctgcaatggctccatttgcagacatatacccaaacttgaagtaggggcaaacctcatacagtatgtgcatgtaggagagaagttcagcactttctggttctttgcatcttaaagatttgtatattgaactcccagaggcggccaatcgggcaacaagtccttccaacatgtatactcccaaccgttgaaccggatcaccagaaactgacaccacctgccttaattcatccatcagccattgtgccattagcaaatcattgtctgaaatggatttggcacatgcaataaggatgagctttaggtttttgctagaaattgccaccattgtttgtctccaactgtccatctcaagtggaacgaagttgtttccattgttgatggcactgtcataactatcaagattatcagagtcagggccaagcattacactttccaactctctgagcttgtgcttgaagttgaagctgcttaaatcatcagttatgcaggagccactcataggagagccataggtattctcaggggaatgatactggtcaggtggatatgactgagagtcttgctgcgatatggggctgccgttgggtgagaaactaacagttgaaggggagttgtaaagagctacagaagatgactccaaagtgcagtaaagttctgaagaacttggagttgaaaagtgagtaccatggcctccatcatggtagtatagctgttgatttcgagtctgatactgcggcaagcagtatgcttcaatttgttgtaatggttgatagtacatacttgaacttctatgttgctctgatgcctgcattatagaattgacttggtctcaactgtgttatagtagttcaagtgatctcttccagcagattatatgaagaagcagaacaatggacaatagtggcctagagaaagctgctaattgatactcatggcaacaaagatatagtcctgagttgtcaaggttctctcttctgggaggttataaaccacatatttgacataatctgctgtctgcgtggaaaaatcacaacgtcatcagtgttatcatatcatcaactttcaacttgcttccaatgaattgaagagatagaaagcaatagctgaaatattcagttgacaggaaccagaatataaggacaacttttttgtcttattaaagaaattaggcactcttcagggtcagcgcactgttaaaattagtttacttttttcttctccttctaccgtgtattatcaacaacttgactctcataccaagtcaaacaattcatctctctgcctattttcttttttatgacaaaaaatgaagaactgatggaatcaattagaagaatttccaagaaacttcataaacgaccaattctaaagattattgatttttctccaccaaaaaagaaagaaaaatacttcggaattgaacaaagagaagggaatagatattcagaaagggaaagggaattatctaaatatgaacatctaatttccattaaaaaattcaaaagatgagacaagcagaactatacatggccccacatattgtattgaattagttttcatttgaatgaagttaatcattctaaaaaactgcagaattaacatttgcatacggaaaaaggctcaaccaaatctaatgaaaaatataatttttataaatcacagttaagaaaatttccaattctactagattaactaaattcacttggctgagctgaaaagaagaaagcttgaatgtcagacagaacagattcacaaaccacaaaagcagtaacagcaattggagaagtgcttttattttttttctttctgagtttgatgaagttacagatgttgttagctgacaacaactagttaagacaaggttaatcaaaccaccccttatacagtactcacacacacatatatatatatgtgtgtgtgtgtgtgtatcaaaacaaaatttgtgcaacaagcagataggttcacagaaaaatgcacatcaaatcaaagctcacatctcattgcagaagttggttaagaaacaattaaagagtacaaaggaaagtttgacatttatgcaaaaaccattcacatcataagcagaaatgctaaaacactagaactcaaaaagttcatgggcaagaagtattaacagaatatgttttacttcaccaaaccgtttggagaaacccttgtaaatcaatgaagatcaaaactgaagcaaattttcaaggaaaatatgaagccatgaatgaaatggcttcagtttgagaagtttttgaacataaaaccagtttcttaccaagtttcgaggaaattctgaggttggaaaaccacagaggattagaatctcagagcttgggggagtgtagaagacaaggctattccaatggagaaaaaactaaggcatatgcatataaaataatgaaggagaaattgcccttccattattatagaaactacacagaaaccattggctggtgttattaatgttaatatgatgatgctcggtgacaactcttttttattgaaatgacaggaataccccttgttaatagtatgcttggtcaaatactgccatcaatgccactcttacaaatgtgcctcacaatcacacgtggcccgttttgagtgagttagcatgagcagcttcacttcaatttccttttcagtccatctacttatctattcattttctcttggacctttaatacctatctttttcaaaagaaaatatgtagaaaaaacaaatacttgtatgtttaattttttcttcttcttgtgcacaattgagtagtatcatacatccaaatttaactacctactgctacaaaaaccgtagttcagtacttcatttcatgaccacaccacctcctatatggtttgcattaatgacttaccaactttgatgccaatttggtgactaaagacataaccattcaacatttcaacatacagaagcataattgtatctgcatacatgaattgttttttgtccgaaatgcaacgctgcttctacttcaatgatcagtaaattttatcatttaactcaaatcaaattaatatcaaatgccgtattaaactgttcataatcattaaacgtttatcatttaatgaaaccaaattaaatccttttcactacttagacaactgattaacaagttattcattacttatatgttcactcaaacatttctctcgttttttaaaattattatttatatatttgtcttatttcacatcgtgaaaatcattgctgaatacggtattgaatactgctagtgaagtttaatttaatttgtcaaccaatgataaaaaataaaaaaaaaaaaacctcggccaacaaacttaagttatttgaagtaacaacccccaaataataagaattaattatatagattattgtttaattattatagacaaatattagtaatatacaattaataatgataaatgataatgactatccagggtggtttagctggaccgatatctcttgcacgacatgtatgagcaacgacatcagtgaaatgacatgctcatctcatcttatcggtcgattgtagttaactattattattagctacaaaaaatggtactttgtgttataatagcttctgttatagttttgaaaaacgagtgtatttttctttctgttggtcatagatggacaatacacgactaggaaaatccattgtcatttgaccccaaaccattgatacattaaatagaaattcgagtgtcactgctcaatataccatttattctaccactagcaaaatccaaacttatctctgatttgagaaaatttaagagtaattgtttagatgaaatacagtggtgcagtaagttgtttgaaaatcaaagccaggagtgatatttttccttaattctttcaaattgaagctgagaaatagtttgacatgaaactggtgatagatcctcacgaattaaataacagaaactaagatttaaaggatatttatctttgccatagtttgctcaaagaaagggagactcaacagtttgcaagtgcaattcaggggattgcagtagcatgaaataaaaatttcccatttcagttatttggaggatggcattattagcacatcaaaagcaagaaaataagaactagagatgaatgaaatctgaagtcttgagagaggattcacatttcacactggaaaaagatatcgagcaatatggtatttggtcttgtgaaaatgaaatgtgtatatcttagttgttctctaattttcaaacaaacggtcaaattttgggagtgattgttacaagtattttaatgagaataataataataataataagccgaaccaatataggttggtgtggtgtccacacttttaatctcaggaaaaccatcatccgtgaccatctatgcaagagaaactgatataaactgcactaacttcgaagggatcaaaggtatatagacctaggttatacggaaagaacatatgtaaccgagtgtgacacaggaaaccccacttcgttgtagattatgttatatatagtaattaaatgtttcctactttttgcttacctcacacacaacaaacggtctaaaaatcatcaatttaactcctctaaagtgaaaaactatataaagtgaaaacaagaatttatctactctggattaaaattaaaataccatgtaatcataacgtatttttaattaaaaattcgacagtaaatgcgctcctactttatcactttagacacttttttcactttagaagtgccaaataatcagaacctgacttatacaaaggtacctgtctgcaattaaatcttgagaagtgacaaatctattgcattcataagtagtaattatgttggatcttgtgcatgcatgtatgcattaatctggttagattcactttttatttcaggtgcttctatattttatcttagcttgtgccaactaaattagaaaactaagataaagagggtgtcagcaaattaaggtcgttttcgtaatttaacgaccatattatctttttattttcaaattatatcgatcaatagtatacataagtcatcagtgaattgttgagattaaaaaggtagaatttagatgatgacccacaccacacggttgagttagaacttagaagagagagaaccgtacaataaaggcagtggcaccaatgatgtaagtagtgccttacacttcagctaacatgcacttgatctccatttctatcaaatttagtaattgcaatttatttattttttaaaatctgtacatttatttatatatgtattttgcttgttgcacttattctctttcataatccattgaacttatctcagaaatatccaattagaatctctaaagctttaaaataatcactacttcttatcctaatccaatttgaagttataatgatgcagcctatggaaagttactgctaactcaaattattgaagagtgcacattcctggaggatatctttcataattgcgtcttcaacttattaaaagcgaaaaggattgggcgataactgcattaaggtaggtaaagtgaattttcataatcggtgataattaggctttagccatattttaaattgttttttataatgccaaattcagattttcctgtggtttgtacaaatttaattataagaagcatctttacaatagattttttaatacaacatgaatgcttttttcattttatattcatgtacccaatgcacactagtacgaatataaataatttgactattaataatagggcttaggacaacatgtatcaactttttggaagattgttaataaacaatctgcataactgactttgaatccacgttgtttcaaatcccaaatttaaaataaactgactattttagaagaaaataaagataaaagacaaagcaaagatccactcacgactgtttatattcctatcttggccgtgctactattatttattaaggtccaccatacatacatacacatatatatataaatatatatcactttatacgcgtgctcttatgatattgttagatcatgttcttaatgaaatgctgaaagaccaacggaaaaaaaatgcctaattctttctctagaaaccgtaaatgaataaaatcatgaaggatttttgttttttctttgttatagtcagatattacgtgaaaccaagtgtcaaattattatgcgtccattgatcttacaaattataaagctcccctgccaaaacatgaaatagtctattgatgtaatttagcaagtagttttaccctttaaatatgctttggggaatcaaatgtaccaaagaactaaaccaaaaaaagaagaaagaaaagggaatcttggtaatactttgtccagtccaaagtgagtgaacatcatggcccacacccttacctgcaattaaacctttatttgtcaattgctctaatttggagttttgtgtttattctggtgtgcgccagcgattttgtcgaagatctacatagagagcaaaatgttatttatttgacatatggtggagcatatgtacttaatttagcttctaggtcaagcgaagatgatctctaatctctctcaaataattttttatttgcttttatggtttgcatctgagttccagttggacaagaaaaatgacacgagatgaaatgaaagtgacataagccatttcgccatcatcgattgtttggactctaatttgattccccacatttagatcttgatatcatgtcactgattgatgtaaaataattcttctgtcttagatgaattggccgaaggatttgaatatcaattgagttttttttcttctttttttttttttttggtgtatatagaatatcaattgagttgaaaattgctttataaaaaattgagttgaaacttaaaagataaagcatgattaaatttcagataaatcttgaaaaccaatcaagttttaatgaaatgtaaaaaaatttaaaggtgggtaaaaatttattttgacaaatttaagggaattctagaatttggccaaaaaaaaaatggggcaaataccaaaccgtttttattttttgttgctttttgttttgtttttcttttacgattagcttaagtgaatatagggttgaatgagacttcatataaaaggcataaatccgagtattaagaaatgaaaagaaaaaaaaatgaaaggatgaaaaggaaaaagaaaagaaaaaaaaacttagttatcattttataaaaaatgccatcacgtaattcttgctgaatttttggattggccttttgaagttaggatggagttttggatgttctttgctttacgcctggacttagggccatcaatcaactttctgaagttggtctgttgtttcaaatgtttcggccttcaagtctaagtttcttacccttatttgataataaatttgaaagaacaccatatataatagtttgtttcaatatttatgtggtggaactcagagtttaaaaaaaaggtttgcttgttattgtaatacctttgttgttttcttaatatttataatagtttaatttgatttcagcactgataattttttttcaacaataacgactcaattttgttagttacaatactatggttaaaaaaagagcaaaagtaaaacagtacatctatccttgttatccttctttaatgtacttcattcataaagtagtataaatctaatcaaaatattaaagtcgtctaacaatggcatgttttaacttcaacgaattgaaactccctttcaggtccataaaaacagagtaatttcccctctctacacatttcaccatggttgactgcattttcattgttgaagagttaaaattatttgataataagagataaagtcttgggaatttagtatgatataataagattagaaccaacataattaattccaaatgttaattttaataagtcaatgactcataccaaactagtataatttaccattactcttcacttttttgtccaatgtaatattagtttcttctatattacttcgcatctcagacgtggacaaaacaaaacttgacaactaccacatgactagatggtatttatttgtcatgtccgaacgttaggagatgagttctatgattctatctcaacaactatttccacaggctcacttcatgtgtagccatcgttatgagatctgtttttcttctcccacgactttcacattgttgtctctgtacaatatctggaagaataagaagatacgtttgagcttgcaaaaataagacccaaaacctaagcttactggtgaatgtctcatcccctacattcattgttcaattcttctatttacataaaattttaaaacttctttattttagtacattatcatgcacaaacatttacctataaatcattaatcttatcatatggtaaaaaaaaaaaaaaaaaaaactttaccacttagtgttaaaaatgagttgaaatgaatggaactaagtttagctcgtctctttttaataaaaattaatttggtttaaaatttaatttgagttcaatatatcaaaatgatgagcagttggagacaagaaattggtagatatctcaatcaaaagggcaaaatgcttgcatctggccatggcaatagaatagcactttaggctagaagaccctataacttgcgtgccttacataggggaatgtagggctgcgtttgtcccccactcccaaagcactaaaatgaacttgaactcttagaatgaacttgcaatactgttgcatatgcacgattttctacttatttagtatatttatttatcataattgaatttatttgttttcagctagatgtgaaagtaaggaagatgcgttggtcgaatagtagcccttaacattgaaggcgttggttaaggcaggagcagaaatacttgtgtgtccatattatacaatatgcatacaagaaacggttcacacacgttctactacaacctacaggatagcgaatgagagtattcgagctttctttgagaattatgttgtacaaaacttatatataattctataaatactgtttgtattatttgctaattagaattagagttccaccttactaatttgtgttaaaaaagtttgtattaaaaaattatgtaaattattgagataaaacttcaattctaataaaaaaacagtgcaaacaacactgaagcaaagtttttttttcttccatatatattctacacactctaaccaataatgagtgaaatctctctgctaattaatgtccttttagtgcgagtcatgcctaagttaaaagacaatcagacctaatgataaagtggagttcattttattaggcatgtgacatattagaaattaaataatcccttttcttaagtccataaaaattctccacgtagcagttttcaataattgatcaattcaattcattcatataaatgggaggtttagagtaaatttcagttttgactttttttaaaaaaaaattagaatatttcaattaaaaattaaagattaatctcttgatgtattaaaatttatttaagagattgattttaatgtataaacaaatgttgttttataaacatacatatctagagatcaactcctaactatatatttaagagacataattatctatcaattatatcacatcatatttttttttaactaattcatttcccagttatgcttaactaaacaaaaataatatatgatatgcaagtttgaagctagtttaaaacctaacagtaacagtaaaactttgaagatcaaactttaatgattaaccaaactgcataagcttatcaaaatcaagaggggctctagacattcaagttgttgtcagaaaatcttgatcaaatagcaaaaggttgtccctcgaccttggcatgccgattgtagtactttaggatgcagagtcttgtaaattgcatacttaaaagacaaaatgtaggccttgctgataaatatttgtcccccgtttccaaattcctaaaatgaagctgaactcatatagagtgaccaatgtttaatacacacactcacggtagctgctatgtggggctaggcttaaactcggtccaattacatttctgaaattttaccaagtttcaggagtgtgtttcaaaaccaaaaagccataatgagagcgcttgacttttgtattcagttttgctgtcatggcaccgcccatgtaaggccttttgggagatacattaccttaatgttctgtcctttttcatctgcagaatttgtcctattcttatccaatcaattaccaaagttgcagattttgtaaattttaaagggtttacattgttcatcaacatgttctgccatgcattttggccaacatatgggtccctcttaccacatgtgcccatctttaatttggaacatattctttactcggacatttttatttgttcctgacgcggcaaattccaattgggatgtgtgtagtggaggagtttgcatgtgtgtatgttccaaatctgattttgggttagccttttcctttctcaatttcaaaatcatccaaatccatcactccaaataaatatttttaaatttacaagttgcttaatgctaaggcatgcgagggtgtgtgcacgagttatacatatatcaaatatcaaattgtctatttttttatattgattatccatcttctctcttttgtgtagcagtaaagaataaagacactagctcctacgaaaagcatattagccgaaaagcaaatgacacgtttaaaccctatttcagagggaccaggtaagcaagtacttgatacttaattataatttacgttagccaacctatattttctctaaactttttggctaccttcttgacacgttctttgttgataataagtcatttttctagaattgaagtttcattaccaattaccatatataaatcgtcaaacagcaagtcagagtcagttatttgatgagggcattccaacacactagactaaaagaatttgtttgacaaggtctctttctttcctttaaagttctaaatatttgggaatttcaagttgaaatattggactggacgaaatgaattgcgcacttgtcaagcatagtaccaaattttaactggcaaaccaaaccattttttgggtcaatatcatcaccttatattccctactcaattttcaaggatcgaatacgtttgatcaacagaaatactaataagtttacaatgtgaagaattagttttgaataaggaaatttataattttacaaagaatagtgtgttttgactcctgactcgaatcgaataactccataattaagacatgcttttggtaagattcctgggctaggattactcctcaattaatgtatacttttggttttggttttggttttgtaatttgtctgatgtcttaatcagaatgttggctttatttaatttattcaaatgcagagtcaaccaaggactttgactttcgaggaaccatcctgttaattctaattccaaattctaaacagagaccgtagaaagctttgcccctcaaattatattctggttgactcttattgcagggcttctcagtttggttccttgagtattgaagaaaccatgaaaattccagaaatataagagaaaaaatattacaaaggaataatagtgttatatatatatatatatatatatatatatatatgcttttcctatttttgaggcaacaaagggattaagttctttgagtaataaaggatgaaaaacctaacttacatggcatggcatgatgattctaagagagaaaaataaaatttagttaaggactagtttggtatgataattacaatgaagaactaaataattattccgagtggccacgtaattttgattatatgtttagtaatagtattattggcatgaacgactatttgcaaagagtaagtaatacgaatcaatatcaaccaataaagataagtagagagcgaaaaaattatgttgtaaataaattacataagagacattttatgttctatgcatgtgttgttcggaaacagttttgtatttaactagttaggtgacccttgtcatgcatgaattaattttgtttaatatttattttacaataacaattaaatatgtaatatgatacatcattaaatgaaatttaaatatgaacacagtcacaatattatattttataaaaaaaactagaaaaacacaaattgtgtatatacatacttgcctcaaacaacataccaaatttttttattttccaaccattgttattaccaaatccatcaaaaaatacccccaaaatacataaaatattaaatacatatttttctcactttatactcacacataccgcaaccaatatcttcgcatgcacttgtaggatgttttagaattataagttcattgcatccaaagctctccaattcttaatgtaactcaattttgtgaactacatttgttgtttgttactaaaactggctcatgaaacctgcatcactactcattgcatctcgtaaaacttaaaaatatatcgaaaaataaaaaattaaccttgaactttgattaaagggaatatcaggaaaaaacataatcaagcattttgatgttggggtcaaagggaacatcagaatttagatggcttgaatttaaaaatccattttggccttcaaaatcgcataattgaataacttgagtagcttttgataatgcaatttgatagaagccgagaggcaaaaactacaaataaattaaaagataatatgaagattaataaaacaaaggaggtagaataaaaaattcaagaaacgatacataaatgaagaaaagatgtgttgcctgacttcaatttgatatgcttaaatgcctgaatctcaaattcaaattgtcacaaaaaataatgacttagtgaaatatagaacattttaaatgataaaataacttaaaaaaagaactgaaaaatgtagaagtatcttttgtttctcatattccaacatgctccctcttattgcttgtggtttgtacctcgtcttattaaccctaatgtcgaagcatgccctacaatgttggattgagatgcagttggcgatgtgacaatcttgtggaagccaatgtagttagcttatttgaaagaggcaaaaaaatgctacagagaatttaattgaagaaaggaaagggatgaagaaaaaatggctagtacctccatggggtgtaggtgaagaaaactcactagagcataacacaaagatagaaagaaatgaaatgagttgataattaagggtgttgggaagaaaacaaagcatcaaatggaaaaaggaaggtataatgtgaaaaaaaaaattcattgaatgcataatgaaaattgaagaatcaattaagaggttgaagaaaattgaattgatgaaataaggtgagacgaaaaaaataataacattaaagaagttgaatgattatgagtactcatttagctaaatgtgttggcattaatgagcatgaataacaaagagtttttttgtaagttagaaaaagaagttaaagagtccaaaacaatcattcaaagtagtttaataagaataggcaattatgatgaaaaattaggaatcataaataattaaatgttagtagagaaatatggaaagacaaaaaagtacgagagaaaaggaggtgaagattttggagaaaaaaatttgttgaagaaataagaactattacatatataataaattctaaatctaataatcactcttagtgtatatttgttttgaggggaaattttttatttgagtaaatagttttgttgatatcagctctaaatgtactttattaattacaatgtaaaatgatttttacatttctaatataataaatgtttttcaataaaaacttttcaaatttattttcttagcatcaattttaaaggttaatgtttacaaaatcattattttaacttcaatatacttaaggtatttttttactaaatatttctactgatgcagttaaaagattaagggtgtgtttgaaaacccatttgatccacgttacggaagttttgcactttccacggcataaacacagaagcaatttagcaaggtctgtgttgaattagcgttgaccgggtttagttgaacccaaatgatatttaaacactcactaaccctcgaactcaaaatagtagttaagtaaaggcattttcaaaaataaattcagctaaaactaacccatttttcgttacaaccaaactctgttaagtatattaaaagaattgtcaacaaagcatgatttcctttttgatcaggttaacaaacctttccaaataagtactttttaaagcttaactccactgatcaaagttctccaaaatccaaaggaataaataatacttgtaagcccatttacctattcatgggctgtacttctgcatattgaggcccatttaccttttttttatttttatttttatgattcttaaagagtaaaatttatggagtaaaaaaacaaactaaaaagagttaaatttgtaatccatccatttttatacgtaaatttagattagacttactatttaaagacataaatgtttctgaaaatataacagatttaggtaaaaatttcttctctaaaaaacaggtaaacatttctcaattaaaatgagaatgacactcactttatagaacagcaaagaattctttctattcacttcctcttggatataaatgctttgctcatgaactacggttaatactgataaacaaattaaggttaatgattttaattattaatcaactaaaaaacaattttcaaatataaacaattttagattattatgacaagttttctattgtaatgatttgaatgtgagggacagagtaatatatgaaaacaaggacaggttgtgcttaagatagaacaacttcgtgccaacggtaccaatacactctttgatccacgctttagtaatatattaaagttaattgtttcaaatgtgagggccagagtttagatcattacaatagaaaaatgaatcttcttttctgttctgttccttaaaaacagatgttcagtaacaatgccaaatatttgatgtatgatcaaactctctctctctctgaagatgcttatgaagatcaaaaaactctagaaagacgatcacagtacccaaaccacaattggacgtggggtgtgtgcactgtgagaatgaaaaagagagagctagaatgtgtgtatcttgcacctttggtgatacttctatttattctcactgacctgtgcaaaataagggaaattcttgcaattcttgatcataatctttaaaagatgaaccatatattatcaatattcttcatacaaatattatccatgatcttctcttgattcggataattatttaggaggtaattatcccttgaagtttgtcataaatctcgttgtgctgaccgtactgggcttcttggtatttggcccaatattactcaaccttaacacactctttaacaatatattaaagtgtcactgtttcaaatctgaggagccattctttagaccatcacattagaaaaaggaaacttcttttctgtctcactctttaacaatatataaaagtgatttgtttcaaatgtgagggccatagtttagaccattacattagaaaaatgaacatttttctctctcttctaccctagtttttgttttcccactgattaaactttcaattctagaatccaactctcgataactaactcgatccttctaccttgattcacaaattgtcatatttcaatcgtattccttttgaattattagaaggtccatcaccacggtctaattgtcaagtttgaatttgaggagatctcctacaattcatgaatgaaatggtccaaggcccagcttggttggaagagttcatcaaacttacatttaatcacaatttatatacaaaatagtctttcgaggatgtttgatgcctctgctcattagtcattcctccataactctgccccgaacctatgtttacacttaaaaacaaactggtctgcaaaaagacctaattttcaaaggttgaaccagctaaattcataacttctaatatccaccgtctataacaggtcaaatatttttcatcttgactgctcgttaaataattaatattccaccaatcacaacaaaagtggtccatcatgaatcactttatattagtccttgttaagtgcagctagagataatttatactaaaaatcagtatcattgaatagtaacaagagtgacgtgatcaaactcgtcatcacttaatgtgtaatgatactatgttaagaatcaataatcctaaaaaattagagattttgtactttgggtgcataacatgggtagaagaatcatatcctttttcaagttaaattttctgaatataattcacaattttattagaattttttttagtagtgatgcccaccaagggatcgtatagaggggcaagcaatgttggtccaagatgaatgcatgccttcttaagtcaagcagcctcccgggtttggtccggaacaagtatacctgcatgtttggatgcacgtttaaaacaacttgattcacgtcttttgctctatttgacgtggaaatcctcttatacaaacacataataccttgttaaaaactgagttcaattgagctacacgtacattaatgtaggaaaaacttaatttagttttgtaagataacaagttagtttgctagacaagattttattatgactttccagcctttgacctagatcaagtgaattgtaagatttcagcactatcaataatacaagaaaaaggccccaaaaaaattgcttgattgggagtttgggacacataaacacacaaaggcacgagctctagtttttgctgcagttattttaagtcttcattcacggttgtcatcagggaatgaagtcatagtgacaagaaccatgacctgggcacaaacattaagcaaaaaggttataaatcaccattattcatacacttttctgtggtgcaaaacttaaataattttaaatcgggattgttccaatccctgacaactgaaaagggactcgtgtgtggaaccattttcatagaccatttattgtgcagaacggagtggcgtaaaagcagatggaaggaaaaaagtgtaaaagaataatttcttcaggttataatatgagatgagaaacactatttatgagattataaagtataattgttcatcagttgattgatctaaaatttgtttagtgagaatgagaacattactcgtgccaattcagttcaaatttttctgtttcacgcacgcttaccgaagtagtttgaatgtagtttaaagattttggatttatttgtaaaatctatacttgacagattaaccttcaagcatgaggttcatttaaattgcactaattgactctgtcatgtgaacatgcattatgtcctagttaaaccaaagtaggaaataagtgagtggttatcaggaatctatttaatacttactaggatccacttctgttgttatggcagcacctctgaagtggcaagaacctccactgtgcttgaacttctgatagtagctgttgaaggcataagaagcatggtctttcaatgtgtttggtaaatagcatggttggtttacttgaattttgctacaatctgcaccccctttcccacaagcccaatccaaggctgcctgcaactcagactccgtggtctgctcatcagctacacaccattgctcaaactccgcatacgctgcatgatatgtagtttttaagatgaacactttgttgaggatgaatatatatgtacaacatctaatctatcatgtaatcaattttaacttgaatgatgtattgctctttattctcattattataatctcataacaagtccaattttaatccagaatcttattagattaactatttaatcaaacggtaaatatgataatgaaatcaaaaaggtttttttcctcaatggggatattttttttatttatttactaaatagggtagcatttaaaaaaattaccatttggggttctttttattttcacgactcttttttatttaaaataaaaattggtcgctaaaaattgcgataaaatattgtagtcgcataaaacaacattctatcgcaaaaagtattagcgactgaaatagcgactaaatttttagtgactaatttttaaccatatgacacgacttaccctcaaatggtaatttttttaaatactgcccccatttgataaatgaaaaaaaaaaaaaataccccctaatggtgaaaaggccaattaaaaacaatagagggagaaaagaagtaactaggaacatttcaatgttttcatttatggagtagaggaagcacatttcgattacctgttttcggaggaatcatgaacaggaaaagtagaggaagcaccaacttcagcatgaatgttgccatttttggagaaaaagataagagaggctttgctgattgataaagactaaagagtttataaaatagataccaaagatataagcaatgtggttacttatatacatagccaaacaaaaaggcaaggaagttatgggtctctttctaacggctaagaaggaaatttatgttattctcttgcaagtggatcatgcagggttggtcacattgaaattggggctctcccttgagaataacatataccatcattgacagaaagaactgagctgtaacatagcaaaagcttatttgttatttctgacgtcgctgctaatttcagcggttacactttgtcacgtgctccacaatcacggaaagaaaaacacacataaaagacttatattcttaactttctctgatgtcagacgttcttccaactcaacaaacgatttacctttttttccttatcaattacaaaatgattatttatctaccttatcttccctttccccacactcttctgttttaccaccacttctttttttgcctttttcaatgggaaaaaagtcttggttcgttagtggtcctcatgttctactgtatctcatttaccaaaatctgtagccttgtagctcaatattcaactttaatgaattgaacattttttggtcttgacaatatttaaggaaaaaaaaagttacaaagtgacaagttggaatcttacaagtcacaaaatattgttacatatgccattctactggtatcatgtaaataattttgatttacatgttacttacaaaattatgagggttcaaagatctgtcattcctttccatcttggcccccaaaaaatgaaataatgatgtcgacactataagatttttatcttatcctactagctccaaatataaatatttacaaagaataataagagatgggaagcaggaacaaaaacggggtatgtacaccaaaacgcaattatgccttctgttgacctcctcctgtcctgcaataagtgataatatcttgaactcgaaatcagcatcctggaaaagaagaacaaaataagaacaaaatttattaatgcgggaataggcttatactcttattaaactcctataatggctcaagataattgaattacaaaggaaatttagaattgtaacacatgtatatttcaatgatccatttctacttgttaaaattataataaatatatatgtatgaaatgcgcttataatataaaaatcctgggatgataaagatggtacttactatcactaaacaagaccatagctgagatccatgatgctgaatagataactttgatgctggcaagcagtctcaattaggaacacatcatctggggcatgtccaaccattacaatatccggacataatttagccaaaattaatccatccgctagctcttttaatggaaaaccaacaaatggcattcgatgataattgatatcatactacacatcacagtccacacttgtcagcaggctgtctgcactaattatcaaagatttcaaacttccacactatgaatctgacttgaagaaacgtgccattgctatgtagagcttctcttcttcaaatggctttgacacatagtcatccattccacactttatgcactcttcattggaagactgagttgaatctgctgtcattgcaagtattggaatgtgccaataagggatgctaccaaacatctctgcagatgcttgcccacacgcaattttctcatttacctcactctcaagacaacggatttgcctcgttgcttcaaaactgtatcatttaagatgaagagaaatacttgtaagttatatctcagccatgtacccagaattccaggtgtgagatcctatctagaaagcactcagtaatctgttatttcttacacaagttaaaatggccatcgatcacacctaaggatatcatgatagcatgcagattggggaatttataaagtttcttatatacactaactgagcccccaagaggatatttcttacacaagttaaacgcccccctagaggataaaaaaaaaatcacaagatagtttcatacattctaataaaataaataaattacaaggcaaaagcctaatcattatatctatttacataagattgagtggacacttttacagtttaacaacacggccatgaggcccgggaaaaatcagtcgtggttaaaatattctaggtagtaggttcttaacaaaaggaaataagggtaagggcctgacttttggcaccagttcctttaattattatctactgtttttcacgtgttttctctggtacaaaataaacttactagaccagtcattgctccttggttctattcttataggaaagaacagtgtctccatttgcattcaaaattgagaaaactaaaactaaaataaaaaataggaataagaagatatgttacccatccatttctggcatttggagatccatgaaacaagcatcaaaattatgtggcagtttaagcatctttagagcagccctgccactctccacagcagtaactttagccccatatttctgtagaacaccttttgcaactcttctgttcactgcattatcatcaacaaccaaaatttgtttgtcaattaataaattcccgagtttggacacttttttcctatttactctcttgttttcagtgccaagggatactctgtaacactgaatcaaagaactaagccaaagaggcttcatcagtatatcatctataataccaactgacttgagcccatcctgttcattggagctaaggtgggtggccaggagaaaaatctttggtaaattcattggatcccctttgatgccattctgtctacgtttcttgattgtgtataagatatgacattctttatcccaagcatccttgtctataagaatcatggccaactgggtcgacatactgaaggaacaaaaacagtagtagtaatttagcaaataatagcctattgtccagtacaagttttttttttataaaaaaatcaacaaatataaactagaaataaaacaccatgtttacttcatgactaattgcaccttaaagttactactgttgaacacaagcaattgccaatattgattaaaaccaaccagtagcaaaaaaagaacaatgcaatttattaataacaatataggaaccgaatttcctacagaacaccaagcagttcaagccttcacaagatcacgcaaaattcatatccacacaaaagcatgcattgaggattgggtcagtctgaaaaaaaaaacatatatttcatgtgtacaagttgtttactaagtaaaatgatttcagaatataaattatcagtatcacctgctttatggggaatacaacaacaataaagccttatcccactaggtgaggctggctcgtgtgatccatgtagccgctctcacctagtgggataaggctttgttgttgtattccacataaagcaggtgatacagataatctatattctgaaatcattttacatagtatatgacttgtacacatgaaatatactgggtagtgccctgatgctattgaagaatgacagaacttaaataggtaagttcttaaggtttattgtgcgcaactgtcaactgatttggatttttaatttcaactgctaaagtgagtcaagtgacaaattacctcttgttacatgcattagatagacaagagcatgcagaattcagactgtaagttacatccacagacattcccaatctctgcagatgatatcttgtgacctcagctcggatttttctgctatctaccactaatgttctcaatccttggaactctgaaccaaaatgattattctgccgcattgcatccagagacgtgctttctccttttctgaaagttccggtaaaggaaaaagtacttccaattccgggctcacttacaaatccaatttctcctcccatgaggtcaactagacgtttactaatgctcagtcctattccagttccaccatatgttcgggaggtggaactgtcagcctgcataaaaggtgtgaatatgcggctttgtgcatctgtaggaattcctatacctgtgtcctcaactattactagaagttgaataatttcaggcttatttatgccacctaactgcttaaaatttgcccaacttttccatctgttgcatacaggaaacccacttaacgtatcatatgttctgtttgatacgttctggttcaagtttaagccttctctcagcactgcgtccataatatgaagtgggttcttcacttcatttgccagatgaacagagacaaatacatgccctttatcatgagtgaactgaaatgcaccaagtaaactgattaatagagaatataaataaccaataagattccttcttttttattccaaagataagaaaatacactaatttaaaataaaaattcgaaagattattccaaagtctaaatagaagggaggtaaacatataaatccttcaaattgtttatgtagtattacaatgtctgcccattgcattgcatgagtcacttactagtgagtatatatataaggtgatattgtaaagaaataatgaataaaaaacaatatcaccaggattatcaatgaatttacttattaacaccatttcaatatcaatcagtaaagggacacactttcaaaaggacaaaatgatgcattgtttaaaattatgagatgtttccagcatcatgatatatgcaaagaataaaatgggttaaacccacccaaaaaataacaatacagcatgaaataatgcaaaccttaagtgaattgccaacaagattagtaattatttgccggaaccgtttaggatcgccaatgacaactttgggtacttgattggatgtataaacagccagctggactcaccaaaaaagtatagagaacacaagttcatgtaagacttaatgtacaaattataggaggtacaaaactaaggtagcggaaagatacgatctcacctctattactttttcattagatttttcagagaaaagtgataaaatttcatccagaatagctcgtggatcaaaggctacagcttcaagctcaagctttcctgcctcaatcttagcttgatcaagaacctcgcttatgactgagataagatctttaccactcttgtgggcggtttgggcacagtccatctggttttcatcaagctcagtatccattaacatttgcagcatacctggaaaattatttgaaacagctgataattattactgagtattgacaggttgggtttatctatgaaaacaacaaatactttcaattacctaaaacaccattcattggagtcctgatctcatgtgaaactgtcgcaagaaactgcaaaaaagggaaagcaatccttggaggtcaaggtggaaatattaattttaattaagtaaaagaaattataaaccatcagaactcagaaataactttgatgttgaaagatgatcatcatgtgatgcaatatacatatgaaatgtgacaagaattacaatattcttgacatcactctaacaattgtgcggcataacagaaagcctaaaaaaactacgtaccccattgcccagagactcctcgctaagcgaaggtaagggggagggatattgtacgcagccttacccttgcatatgcaaagaggctgtttccgaattcgaacccatgatcaacaagtcaccaaggcacaactttactgttgtgccaaggcataacagaaagcctaaatcccataaatatatcacacctgagattttgccacatctgcagcttcagcacgaactttcagctctctcatttgacgatagtcatcctcaacttttgctattctatttattgctgcataaaaaatatgacccagaagcaaagtaataacaaacacccccactgatgcattgattgctgtccaaggtaatggaggcctctgcttgaacctgcaaaagaaaaggaaaagaaggaattgtgctggtatgagatttcaattctttggacacaacacaatttttttaaagtgtgaaagcaaacctgcagtgcatctcatgtttgcgtagcggatccccaaaatctaggctgcttatgtatagtaggccagtgtcagcaacatcagtaccatacattgtgattggtgcagatgcattagttgtgtcataaacatttacaacaatggtttgtttactggcaagttggtgtagaagcttgtccaccagtgatggaacatcataagacgcacccagatacctgccaataaataggtaacaatactcacataacactgtaattgttttccttttaggggtggtggatcagagcacaaatgaaatgcatattttaaccagtagacaattagatgtaggattaccccacagtagctttgatacgctgctccagtgtagcatctaaaggaagattagtgttatagacagcaaatgtaagtacaacacccagatgattggactttagtagtttaaaaggggatgtcagaaccccctttccagacgcccttgctctcaaaatattctcacggtcctcctgtgtaacaatgcaacaaaatattttctgttaaccagacagataatgaggaatctaataaataattcaatagacaatagtaactcctagtcttatttcttcttaatctgtcactgagatgaatgtaaatcaactgattaggcatgaaaagcatgtgataccagtgctcagagtcattttattgatgttgataagtaaaactcttgtatgtagttgattctgtttaccccacatttgactttcactgttcaaagtaaattatataagatactgtttagtgatctccagttctaatattccacttcatgtatacaaaagctccaagcatctaatgcttcgacctaaaccttgcataaagaaaatacagacaaaaaagtctttctaactgatgacttcacactctagttttctcatacatacttgtgcagaataaatatggtacgaacattaacaggaatgtaaaatttgcagtttaagccattgccccacaatttgcttagaaaaagtaaatcatgttagggtgacagcaagctaagcaagacacaccttccctgacatcatgtcaatagatacaatatgggaaactgtttcttgagcaaatatcactggtgcatattcatcttgaataggtgctggatccaaattttctggaatacaatcttgtactaatgcctcattctcagtttccattttcttaattgtccacccatgctgcttctcaaaatgcatcctatcagagtggagaactttcaaagcataagcaacaccactagtaagtggtctttcaaatgctgtactctctgtatattctccaaaaattttctgcagtgaaacagaagcttcaatgttatttatccttaaattttcttttgtttttaattgttttccctcaagatggataatattacaacaagaacaacatataaatagcagagagttgaagaggactcataaatttaatgtggtttcaacatggagacttatactatgcaatcttcacacatatccaaaccttactggtctaatacaatcaaattcagtgttaaccatatcagaattacaagtgaaaagaggaacccagttcaaaccttgtacacttttttgtaagattagcatatacttaaagcaggtataaagttgttaagacgttccgcattagctagaaatatggccaaatactccttgaaaggcttgagccttgagtaattcccccctcccctttgagctaacttttagagttaagttagatcccacccatttcaaatatgataccaaagtctattcaatcttgatgttaggtacctgtaaatgtctagtcttacaagcttcacactccgatatgtagtcctgggcatgaggggatgcatgttacgatgctccacaatggcttaaaacatggccaaattattccttataacacttgggcaattctctccccctctgttgatctagcttttggggttgaattaggtctagttcatttttctaataaaatttataacaatgacaattagaaatgtggtcaaacatgcttttcttattatagctagtaaaagtgccaaaagatattcatttgataccctcattcacactctcctttcagatttagtttttgcaacaacattaccataacacaatgaaaaaaacagagagaagctagaaattttatctaggctagttgtggagaaaaaataaatcatatagcaagagctttacttcattatctatacttttcaatagctcaaacttttgacacattacggatcaatggcacaacctgaattcctccattttttttgtcaatattatcatatttttcagcatccccacctttttccattacttttgttcattttattttattttatatgtatgcagtttttgctacatgaaagtgagcaacagtgccttttccctagtttttacagatcatttggatcagattttgctttccttagaatagaaaaaacttacatttccttttttactatgcagccactcaaatatgttagttagattcacataagatatactaagcaaaagtgtctaggagacatgcaaaatatctggagtcactggccatgaataagtctgcataagatgggagtgggagaataccaataagagaagagaaggacattgagtacattacctggtcaattgcagaaggatgtttaccatggtgaaaggtagatacaaggatagccagagcatgaacatggttcatgctcacattaaactgatcttgcagcatacgggctctctcatcacacatatttgctagcgtttcttctcttctccgcataattcccatattcaggtgccaaaataaccaaaaggacccgattattccaagtgacacaaatataactagtaactttttcctccacctcccagcaccccttgaaggacctcttggaaaatgtttcaaccacttttgttgtgcagctggatgcccctgaactagcttctgcttttgattcctccatagtaaacagaagtaggacattataattccaatgaggacccaccagcatcctttaattaaattagatgaactcacatgataccgaattgcagataccctcagttcccatgattgcacaatgttctgcaaagccaaaatgaattagcaaattaattatatagtggaagtatttgtttcaaataagcatgcaaggagtgcatgccttcatagttattggacaagcttacaatcagaatctatggtataaatcacattcacaagtaacatgggaaagacaatatttggagcaaataaaccaaaatccactacttttccttgatatgactattattattaggctgtaggttgaatgatttgaaagctagactatgatcggtgatgccctgtcttttacacatcaatacaaaaatttattatagcactagccaagctatagaaagaatgctatgatgccagataggcaattcaagggaatcttttgattacattcaagtgcatacaaaatggtaccactgtagatccagatgatgcattattaatagttacatttctcacccagcttccacaaactgagcactcttacagaaaatgatatttaggaatcctaaagttcatcactatgcttctttttttatctccattcaatcaacaaccatattatgccccccagtataggttgagcagtgagaaaagagaattgtaagctaggctataattcttgggtactccctaatttttaggagaattaacaatttatattatggaacttttgggcataacaaatatatgccttagctttagtaaagattctacctttccgtggtgcaaataactaaccaaatcagttgaaagtgcagagtgcgaggccaatgatacacaacttttcaatgggaatgataattcaagccttgtctggacataatcattgagaattggacattgttctgtaggttctacagtgtctgcaacacatgtatgctcattttgtaactcttgattctctggacatattaactgtggagtactgaccatgccgctgcttaacagcatttgaagtcttctttcatcaatacagttggataaaatctgcatcataaacttagtaagacataggacaaagagcaccactttgttactattcatattcatctctgcaacaaccactgttttctattaaatatctagcaagagagtatccatcacttttagaacttaaccggttgtacaacataaagcgatcctagagaaaccttgcggaaaaagcatcagaatagcatagtttataccctttcatttaagacaatctattggttctcaatattttacatctttcacttcatctcaaatataaaatccaacaagaagttgtttatttagtgacaataacgcccaatagaaagaacagttaatacatagaagaagccaaatagttaaagtttctaagcaaaagtaaataattatgaattatcctcagcgaccacgatatggcgccataaaattgaaagagtggaggggaaagtgtagctcacctgatctgatccagagaacaaggaagccaaagcatgaatctgtttcctactaacattgtaacgttgtagcaaggttctctctctctcttcacaaattgcttcattctccttgctgaccaaatacttactattgaaactcaagatgaaccaaacactccctatggcaacaaagccaaaaaaccaaggaagcaagggcttcctcctacatgtcctgggagaattagacccatgcagaggctcattcagcttccaagacttcatatttgatagcaatctaccatttgaagcaggaagccttcgattcacagacatccttgccaaattcaccaacgtaacagtcctggagattcaaggcaagccccagcagcttgagcagaacattcaaaaagctgaaccaccaagcaccccaccatgaatcttcaactgcaaaagcaaaattgaagcaaacccaaatgttttctcagcaatccacccctcagggcataaagtttggtgctttatgatacttccacaaggcaaaagagaaaagttgcacaaaacccagttgatatatatcaaggaaggagctccactatgcttggactggagtggcccaaccaaaaagtttgtttttttgtgggtatccgtgaaggttgaagttgaagagataacataacaagaagaggaggaagaggagcatggggtaataatcacaccaaatcaaacccactgagaggagctgtgaatgagataggaaaatttgttctttttctataacaggttgtttctgcctcactgacctctgaacacccaacagaagcatcaaagagtggaacaatatcacacagtgaccatcatcttcttgcaaatttgctgatataacccattttgtttttcagaaagaaaatgttaaatgtccccccctctctctctctctctccccccagtttggtgtgcagcattagctaattgaggatggatcatgattatctcatcatctggtggggaaggtttaaccaaaagcaaacaaaaatccatgattaaaaataaattttaaaaggaaaataaaacatcagttttttttaatatcaattattactgtttagttttttcagcaatatatagcataattgaatttttggttaattttaattctttttttttaacttcgatttggtgttttgcttttgcaagagttgacaaagaccgcacccttcagtgtttaaagagggagtactccaactgtgcactgcagaatacggatttaagtgccagaaaagataaaagagagtcagaaaaaaaatatgtgagaagaaatggtccggtgaaacggtgagagaatatagagagagggaataagattttgaaagatagggagagagaaattaaaaaaagggtaaaaatggtaatgcacgtagcacattgtccagttcccagttccatcataagtggaaagtaacactgtaattttatgttcaaaacgtactggaagaagaatgggcaattattcagaggggtaaaggctaatgtgcgcatggtgccaaaatattctggaatcaatggttttgagaaaattatataggtttgataaggggtatataggtgtaatgggggcatcaaataaaatgaatgtcggctatataccttacccaccaatatataataatgaacgaaagtgagaatcaacccagaaatagtactaaacaaagtgccaatttgattaaaaactactatcaaaagcataattggtttgaccatcattgcatggatattattatattaacttaattttttttatcattttaaacatttaataaggtaatcttaattaggtggtgatcaacggcacaaaaaccctcatatacagttttagagtttagatctgtgaatttcttgccttgagagttaatcatcattgtgggatatggaagtagggttatgcctattaattaatgatgatatatgattagtgagaaatacttttttcggaaataggttaagttttaaagtggagtcccacttttatgatttttgctatggcggtgagatttgtcatttctagcaaaaatagtaactaccaacactgttttacatacagccaaattattgctgtttattgtcatgccactttttcttgcgatccagaacatttccagtgcttaaacaatattacaatctttacattaatcaatgatgctaaggagaacctgttatacggtactgttatgttggaaagttaagaatgtataagtttcactcagagagaagaagttttcatagagttcaataaaagaggaggaaatagtatatatacctacctacataagtaaaacctagctaagagtggtagacagacacagcacagattattgtctaatgagattacatgagcttgaatatttccttgacgagttggtttcatatgctaatcacatatgtaagttcaactggatagccttgttattgtttatgtaagtcaatttatttctgtaaaagaaaagtcaattgattgaatggtcttttttgctgtgaaaatatattgtgtacaacatactttgtgcatatccacacaatttggattgagttaataaaataaagcgtttccatttcttatattatagtcagatctataaacaaatttaatctgtattcatactttcttgttaagctaaatataataataaactctttcataaaaaaaaaaaaacaaaaaaaaaaactcatctatttctcattatgtggaagggagggggtgtcctactttctaatgtagaattgaaaaattaggaattgtttgatttgaaaaatatgtttttaattttaatgataaaaatgccatattattttcctatatttcttatttacaaaagttataaaaagaaaaaagtaaaatattttttgttattttttactatttcattatttcttaaagaaactaaaaatagaaaatgaaaacagaagcatttcctcaaaatcaaacaggtctttaagtattaatttttttcacaaatataaattttcttgtaatttttagcatttaacttattcatactaaaaaaagttataaatcaccattttttaaattctgtgataaagggtaaaaaacaaaattccgtattatgaatgcaggtcagttcgattcgggtgatataacaacatattggaatatgatgatgcaagctgaactagctgtgcttcctattggcaccgttactttgttttttttaaggggagtgttcgatcatcattgccaatttggcttggcaccattacttttttttgggctgttcatagttggcaatttggcaccattaccatgaagtacgtttatcaagtaaaatcataaaatatttattcacaataatataatatttttcaacgttattatataaacaatatcttccgccgaaaataagttgacatatagccagaggtaagtagtggctgtatattttacgagaaagaaagtaaaacctacggttttaggagccgtttagtttataaattgatataattaattttaaattgtcaatagtgattaagatgtattttaaaatgaatttgaattataatttttacatcttttactataattataatttttacattgatatacgtgttgtagaaaagaaaatatttttataagattggcaaacagaacacttgagggtcaaaaagaaagtgaccagccagaaaagaattaatccaatcatcaaagcaactcttagatggttaaaacttgtagggccatgcttcattgtaatccacttcggcataatggcattggaagctttgttactttccctttccaacttttcttttcacttcttgccatggaaactaccacgctatattaatttattcatcttttgaagctaagtactatgttcatgtgggaagtgcattactgtatggggcacatcgagtaactatgtgtaggttcaataattacaaaatccagttgggcatagacccaccacaatgcctattattctccctaggaagatttctcttcaagaatatgcattctattcctaattattccagctacaggatttctcaccttttatttgtaacttattgatttaacccattaaagacatggaatttataatctttcgatctattttttttaatttctttttcttgctagaatattactttttcttcagtcaatggttttaaattaatgaatagtaacaagaagaaactattttcaaatgccttaaatttaatacaatttccttgcatggttgtacaataattattttctttatgtgatattattttaaacagaaaccatcttattgagggagggggggagtatttaagacacagcttaatttaggtttggtcgccattttcgtggttttcaagaactaccaaacaaagccgtttaccttcaaatctttctacaatatgtccgcatgtttgtattgattaagaggattttataatgtgaaatttagtattgtacggctgttacataataatccaacgattcaatcaatgttccctcttcgatgtaattcagtgatggttaagaattaagaaatatataggtcaatgaaattatttaaggacacatgttttatagtctactcaccaaagcaaaataattaaagaaacttgtggacaaaggtagggatatatatatatatatatatatatatatatatatatatatatatatatataaccatttaatcataggttaagagagtaagtttcaaggttaatttaatgactgcggtctctagctttcagggggagggaagggaggcaaatatatatttttctttagtgagcgtctaattttcatgttggaaataattgtaagtagagatttcatttgtctggctgaatgaaaaatttgctatccacgtggatatctgaaacaaatattcacaaattttataaatattaacttatttattgatatttgtttttctatgaatggaaactaatatacaaacagaagaatagaaactaaagagtaaatagtaaaagagacattagagacatcagccaataacagatgttgaagaagaaccttgtcgagccaaccagtcgggcatattgattgtcctccctataattatgatcatgcttgaaggacagatcccaatgcaaatgcttgaagttagttatcttttggataagtgctgcatatggatgcatacgaatatcatcctaatccaataactgaagagcaactgtagatttgttgatattttttttggtctaaacagtattgatatttataagcatctatgaatatttatttaaatataaaactttataaaaaaaagtaaaaaaaaaaagagataaatacacattaaaaaaaattagtacaatttatcttatacataaataaaatagtttaatgattatacagtattatcaactacataattttaaaataatcataataaaaattaataaatttatcatacatgaaaatttataattgaatgataatattttacattgtcaatgtatatgtatgttcttcaagtaagaaaatttaagtagtttttaattatttgtactcaagaaaatagataccttattaaaaatgttcaaaatccaaccaaaatgtttaaatcatcaaattgatcccaaaaagattaaaataactaaataatcaattttttcatggtcaattcgttgactgttatacacaatcaatgaaagacttttacaatgtaaatcaattaaaaagtactattgatatgacttttagttgtgaaggtcaataaatttttcatacataatagttaaatacatgttttgaaagattaaatatgtttttattctcaaatttagatcattttttttttggttctttaaatttaaatttattatttttagttcctcaattacaaaaaatgcccccctgaagtaaaaaagtcacaatgcatctgaatagtcaaaaatcaattaagaatgattaaaaagaatattttttaagagactaaaatataaatttaaatttaggaaaccagaaataacaataacttaaatttttgggacaaaaatatatttaattttgctttgaatgaaagacttagtttgatccaaagtcaggttatattttaaagaataaaatgtaattataattattaattatagtttaactattttaaattaataatcataattatacttaactttttaaaacgcaggtccttcattctataggaggcaaatttaagattgttagatgcatatttgtattaatttacttaaaaaatataattacttattttatacttataaaataaatattaaaagaaaaagcaaatcactaacatgatatagtattcgtaagataattatattttttaagtacgtgattaagagcttaattcttatatatatatatatatatatatatatatatataatatagtataatataatatatcagaatatattagttctttaattagatttcgataactgaaaattgcaaccaataataaccctaattaacataaaaatgtaaaaatggcccaaaagaaattgcttattcttttgttttgtatagagaaataaaataagagtaaaaatatgtaagtgaaaaaaagataaaaaattattgttggtttgatttaagaaaaattaagataaattaagtaaaagagaaaagagaaaaataaaataaaatatcataatcgattatgtaaaataaacatatgtaagtgtttggacatgtgtttatgatacacctaactgactcatatcgatccatgttcaaggttgaaactattatttgtataaaaaaaaaaaaatcacgataaagacacgatgcctcaatgtcaatccaaacatgttgattatcaattatatatgttttttaaggcattattttgtcattttcatataaaatgtaatataatttattataatacaaaaatgatccattattattttatcatacacccttcagtcaagtgaacaacgcttctgagactagattctcatcaattctttgctatttcaactttcttttgcaccaaaatatttttatgtaagattcacaaattttaaaaaaaatttcaatacttcttcatatgtcaaactatgaatttcttataattagtacttgtttgaatacttgttcattggagaaaacacatgcacgttcttgagcacaaagaagtatttccttaattacttttgagaaaacagtcattacattcaacgaaatgattttgtaaacataatcttaatcactttttcgtccttttcaactcatttctgatgtgtttctcttcaatcaaatacaacataaataaatttcagtaacttgagaaattggtctctaactttcaatttgggatactgcacattcaaaaaaagtgaatcacaaacatgcagtagagaatagagagagaaaattgaagaataaaactacgtaaggtaacatcagacgtttgatacaaggcgggtaccaaacattaacaagaaatctgaatacagtggtagatggcagccaacagcatgtgtagtctgcctcggatgcacaataactgctcctttcaatttcagcgtaataagctatgccctatgctttagtatgcagctacctagctagtctattcccagttagctagagagacacaattatgacaataatcaaataagatgatcatttttatttgaataaataattaaattcatcttaaaacatgtgattccatgataaattaatttatgaaaaataaaaataaattcaatttttaatatgtaaaatatatgataaattaattttattattaaattttaaaattattttattattaaattataatgtttaagaactaatttcacaaaaatatatatttttaaaaatcaatttgatattaatttacaagtttaagaattaatttatcattaaattatttatgatactaatttattgtattttttacatattaaaaatataaatttaactatttattaagtaaaagttgaatgattatatactttggatttaaaaatgtattatatcaatatgatcatgtctttgttcaatttttcataaatgaataacgacatattattctctcgctactattaatcttcttaagattttatgaaagaaacactgaataaaaaataaatatttaatatttcaaaatatttaatatttttatttaataaataaaagggttatatagtaaaaaaaatgtcgctataaaatgatttattagaatgattctttataaatattactaaatgtcatatttttcataattcttcctaaataaaatcgacaactgtaacatgtacaagtctgaagttgacaacttaatcaaaatagagacaaaactgataaaagacaaaagacattataaattagctcacctatctattttcctgacacacaaccttgtcttgaccaagcttggtagcaacctttgctctgctgatttttatctttgcaaacgtctgtaaccctcaatattagctagctagtgaacattaattatttctgtaaggttgatatattcatcaaaatttgaacttatataatatagtgtcagttagctgtttatattttataataatgggtgtgaagaggacatgctgatgcaaatggctttataaattgagcatgaaagattataatctccaagcttgtcttgaaatgatttaccatattgactcttggtcaaattgaagatttcaaatttatttttgttttactcatataggagctagcgtttggagaccatttgggtaagaaggtgtcccccacctatggtggagacacgactaccacttaaaacaagtggcagttgaagttttcaacagctgaatcaatttagagcatgctcgtgtttcaaagaattaaaatatgttggcgaaaaagttttaagagataagtatgtaattaaaatacagaatgaatattgaagatgaaatttatatgattcgtttttataagagtgttctaactttaaggtacagattaacaaaataaaaatagtattatacaaaacatttaaaaataatttaatatttgatttaaaagaatttaaaatgtttaaccataattaatactcttggatttttcattaatgaaatcattcttttttttagatattaataagaaaatcattcttgaacatacaaaaattaatttttacattaatcaacattaacttatttattttcttaaagttaagttatttatttatgattctaattgtatatgttaatgcgaacttgctaatttaaagcaatgctaattgatgatttaaattaaataattaagaaagtaaaaaaattattattacaatatattgtgagatgaaaacgtttaaaaaaaataaagttaagatgcaaacttttaaagatcattgataaatctacaatatatccaaatttatagattttttttaacatgtttcaaagcattaacttggtggaatattgtgagaaaaaaattcatattatatattttttgtgattcatgatttcaatggtttaaatgaaagaaaaaagcgtgaatagacttctcttttcttggatttttaatgtagggaagatgaacaatagtgagaagcttcaaattttatatctcctctttgtcaaactctagaaatgtgattgaagtcatcttggtccccgtgaaaagcttaaatatagatctatatttttcatgaagattgtttgattagattcaaggtggaacaacaaaaagttattggtataagtggtttgtcacttaggtttcttaatcaatatttgagatttaattttgacttgacttgaatatgaagtgattatcactttatctaaaaatagaataacgatggaaagaaattatacctcttgattatatataaaaaaaaatatatagaaaaaatatacctcttgattcaacgcggaacatagacaaaattggacttaaagttgaagatgacgcgttgtcctaccaacatcaacgcaagtgcaatgtttaaagaaaaaatatagatctatatttttcatgaagagagtttgattatgattcctctacaacatcgtcaaaaacaaatcgacacaagtgcaatgttttgagcatatttagagatgcagatgttgaattgtacagtgtttgacaggtgcaaaacacgggcctagcgtgaacggagtccctgcatatcgctactggacgggcattgttcattgtcgagtgcgtaatgttcactgcttaacgttgaggcgaactagatttgtggaaaatttcatgtctggcgcgattcgtctaagaaattatatcattggggacaatttgtttgatcttcctaggactagaagcgagaaagacttcgacgttcgaagaaccattactagtggtagagaaaaaatgagaagagaaaaaactaaaaaattatagacaaacacaatttgtatatctcaataatttttttccttttaattttttaaccaatactcttgggacatgggttagtatttttcaaaaaattattactcatttttttttcatacaaagttttgataaacctatgtttgccctgcagacacctgtacaatctcctgatctcctctaatatgacattgacatgttgtttaactcaacaaactgcttctgtctgaagttaaaagttaccaacgaagagttctgtgcctaggactagctgttttcgtagctaaaatctgaaaaggatttcctatctttgtctcttaaaacacatctgtcatcgctttatgattcctctcctaaaataatttttattcctatttccttacatactgtgttcatagtagaataagaaaatgggtcaaactcagatatagctcgttgattttcgaggcttgagtcacaataatcactccttgatgggtatgtaattcatgtaaaacagaaaaatgtgaagtggagattcaccttcctctaaaaagggtttaatactgaatattgataaataaaaaaaatcaccttcctctaaactccaaaacaatctcagcttccttggctaacaactacattctccgtacctcatcatgcacaaccggcctcccgcctacattcctagaaaggggaagaaagtgtggcaacataagcgtgaaacaataacgtggctataaaaaccaagcaaacggagatgtcattgcattcatcacacacaatcacaaacagtaaacattcaagcaaaatctcatcctttctctaatggctatctggtttgtgatccttcttacattctttgccattggtgaatctcagtccacaatgtcattcaaccaaaccgacctgcaggtagccatgactgacatgagaagtcggtcctactatggatttgtcatcctcctcaaaatactcaacagccagcccaactcactgcaaaacaatgatttgacattcctaatgccaaatgatgatgaactatctcaattctcaatagctctagaccagcttcatgatttcatactcagccattctattccaacaccattagtgctcagccatctattacattttccaaatggctctgtggttccctctagcgttccaagcagggtgatcagcatcaccaacggtgggagaacaggtttgtttgtcaacaatgcaaggattgtcacaccaaatgtgtgccaaagctcttccataagatgccacggaatcagtgctgctttgacatttgacaacatggtgccttcccaccgagctccaaaacccaaggagtctccaaagaacagcagtgtgacaaacccatccttatctgtcaaaaagatgaatatcccacctttccagtaaggcgagaaaaatactttgcccttcagctgtaatgtcgtttcgttttatcaataacataatattacttttactttgtctccacaatgagctatttggcctgtagtcctgatccaactcactcaccacaatgttaaacatattgactaactaattagattccacaaatcaagaaacaatcaataatttgtcacaaatgcgtattcatacatacaccgcatagaacaaaccgaatttcaatctgagttaagcctttagttactagtacctcttcgatctacaaaaggcttacaatgcttgaaactaatggaattagactaactcttcatcaattgtgcaacagaataacattgctataatatgtaaaagattataacatacactgaacccgtactcatgggtttgttctgaaagggtgggactcattagattgaccgtctgccttcggaggaacactgtagagaagatcatggattttggaatacatcagcattgaagatgggtcacccccactactgctctgtgatacacgagaagtctcctgcaatttgatcttctcatacagatattgcttctcagcctcagcctcacttaatttttgcttcaaatagttgctagtatattcttcctctgatttatctgacttggcaagagcaatcctctggagccgctctgcctctcttttagcctcgttagcctttaactggaacatatcagcctctgcatttttaagcctcacaattctctccagttcttcaatctgtaacttctttttttgcgtgtccattttcagttctcctgcttctctggccttgtctgctaattcacgttcacaagcatcaaaagccaagcgagctttcttgaacattctcatcttctcatcagctactatttccatctttcttatagcctcatgcaccacttcagcaattctattgcatgcctcctggggagcaatcagccttccactttctgcattttccaggctttttggagagtccagatcaagctcttcatatatgaaaagcattggttaaaacaagaagaaaggataattaataaagtaatagaattaattttattgattatacatgtttttaactatgcaaatcacaatttcattcctagatatcttcaaattcaggttttaatgaagagaaagcaggaagtttggagataacctcaaagtatagtctaaaagcttctttttttaatcattcctaacacagttttaatgaaatttcaacttttcagtacaaacaaatactactatgatatgaacatagtaaatgggcccaaaaaaaaaatgccaaaaacaataatgttgtattcacactaggtgcatgtgcatccatgtgcgtgtagcctatgtcaaggcagaaactttaaaactacaatttgcaggtaaactagaaaacttgtaccttggaaaaccatcaatattgccctgcatgctgccttagattccactttcccacttttcaatttttccttgagatcatcacacttccaataaagtttcctccctcgtgggtctttactaccatgaaagatcctactgacaaaatcaagttccctcatcaatgcctctccatcccatgatggtgcacaatgctggaagacatctttaacccaacccagaagttctgaagtcctgttacatgcttgacacctgaaaaccatttcacttggccctgctccattctttgcagaagggcccatacaaataagttgctcacgtatggcacagtctgtgtgagtccaatgagaacacaaatcacatccaatccagcggcatgtatttacttcaaagtcaaacttgctgcagataacacacatgcaaagattgcagaaaccattgccattagtgcacgtctcacaggtacaatcttcagcaggaagttggttttggcaagcaatgtttctgcatctcttgtacacaaatatttcaatcagtgatgtttgtgatagactgatgctaggatgtaaatatccctgaattccagtatttattgcaacaaggatttcaagctgtacacgatgtgctcttatcaatgtcttggctgttaaatcagatctactctgaacaagcttttgcaaaatgaaaaattcttctctatgctgtgagccattccctccctcaaggataactcgaagtccatttttcagttcctcaagaaattcgtcaggtaaaagatgcattttctcacatattatatcaactcgttctcttgcaatgtcctgaagactaattttgtctgcactagaaacacggcgaataactaactgctcaggacaatccatctctgcttttccattctccatcttctttgcagcaattgcatcagcagtaggccaagtttctcgagaactggcactttcagtaggagattcacggagattgtcagagtttgatctaggctcctcgggagaaaggcggggatccgaagaaactagagatagagaggtttgtagtcctccaacccgtgactgctgtggtggagggagcattttctttttctttttcacaaaggcttctgttttatgttagagcctggtgacctacccaaaaaatatttacttagtcagtaactagctaaggggattatataccactgcacatgattatcacatattctttgttatgctacaaatagttaaatactaaaatgttacaaatgagcgaggaacttgagaaaattcaaaatctgctaaaagttgcaggcttacagcctttcatcctctgcccccactccacataaacctccaaaacacagaaacattacaaaagacaaagcaagtactagagactagagactagagactagagagtagagagaataattatcaaactatttagtaagcagtcaggccctaatttttccacaaactgatgccaaaaaacaaaatacattcgaaaaaacatattatcataatctacacaataatcacaggaaaatccatcagtgataacggaaaagaagaaaaattagaaagtttaataccagtgatttcactcttgattctattgtgcaacgagcttcttatcaaatgaagaagctcgagagatatgcaatctctcacagaaactatgatgtcacacaagtccactcatcaactcaaacaatagatcaaatgataaagatgcaagttgaacgacccagcacagaaagttgacattaaaattgagacataaaagtcgctgcaaaggatgtttcaaaggttgatcgaaattcacgcaatcacagcaaaaatatccttgaaaaaataagaatgataatttggattaaaaaggagaggaaggttaccagagagaggagaagaaaaatggaaagaaggctaatcgattggagtatgtatcttccttgttcacaacttaataaaagaagaaatgggggatcaaagaagagaaatgggttggttaggtcaaaataggaatggtgtgtttgcccattttaccctgaccggttcagaccgggaaaaggacggaaccggcgaattaagaagaacacgacaaaatagaataatcaaattgattttatttttgtttgaactgtggaagtgggaaggaaggtggtctggtcgtgttttccaacgatgacttgttcacacggttgactagcgttacatgtttactcattcataattgtgccatctttttcttgttgggcggaagcgttaattaactctgtcaagtaccgttaattttccaccaaattatgccaagtcattacaacgctcctaatcgaaaccattactcttcagtttcattatgatgggtaagtatgattgaaacaatttcaatttcattatactattactgttcagtgcttctttccttggtttctgaattatcatgaattgtgaatggtttgcttttataaattgtttactttcgtttattttttttttattttttttcatcttttgtcacgaattccctttaccttccattatgattacataacataataattgggacccggaccaagtttttcttcttctaatttttatatacattaattgtagctaacagtctatttttacttatgacatcacattataaattacaaagtgaaacaaaactctatattttttatacatctcatctcatttaatataaaaaacatcctcttgaatatctttattgatagattttaaattgagattttagattattttttagtaaatcttaatgtcacataaaattaaagatctcttaagatattttttttaatagtaaatctcattttaaaatcttagaaaaaaaataaaaaaaatttattttttttaaataatatttagatcttaataaatcttcttcaactcacatatatgcaaattctccgctcaggaataccaaagtcactgcaatgacatcaaattttttttcgcttttacctgctgcaaaattagctaagttgcagttatatttgtttattgaatgggtttcctcaaactttcccttgaacaggcctgcgacatttggagaaccttcagctttaacgttgatgcaatcatcattgaccaccacctcagtccaaaactgacgcttgccatcatttttctcataataatctgatgttttggcttggctaccacgaagaatagattgaggaacctccttgtagagtgtccatgacgaagcccgagaatgccatgtgggattagaaattagctgtagatatgggaccttgcatacctgcatgtatgacggatttaggatcctgggttagtaggttaatttattttaaaaaataaaaattgataattatcattatcatataggataattgggtttaaacacgaaaataagatatataaaatataaatttttaagatcaatatttacattttattaaaataagagggtacattaatttactcacatgtgaattggtaaggaggttcaaatacataaaattagaaaatgcaaaatataaaattaaaaagtataaaatataatattttaggacctatgttagtgattttattaaaataaggggtacatttgcccaccctgccaatgtagctccaccggtgcctgcaggtatcaaaaacttaaataaatgtccattttacaaccaactaaagtcaaattcggaaagagtcataccacgttttccagctctgcaagaactttggttggaaatatcctgtgagccaaagatttaaaaaaaatgaccaagaagactggatccatccttttccagtaaaccacaagatgatcataatagtgtgtgcatgtcttatgtctaagcatttaaattccaacacaactatcatgtaacaaagacccattcctctctcctttggcattatgaattttcaatattagttagctaaagcctcaaccacctaggagaaaattgaaggagctaaaggctacatgcagatagcatcaacatgagaaattaagcaaaactgacttgggcatcaatagaaattttggtaaaactgatgtcaagcacatcacacatcaatgcaaaaaatagatcagacaatcgtaaaacaatggagcctaaaatacatttatcatgccatgcataatcattcatcaaaaacaaatttcatttccaaaacgtgatgtaaatcttataagtaagcatagttattgttaagataactccatgagagggcttaatttatgaaaaatatatttaagttcagcacacaagattcaaaatatatgcactaaattttagcatcgatgaacgctattgattgaaaactaatgaatgatttcatatctaacaatacccttccaattattctaatattttatgttataagtactatagaacatatcatttgccaaaaaggttaattacaggagtaattattaaaatttaacttattcaattgagacaagaaaatataatcaaccttaaaatactaaagaaaacctcttcaatatagtcacatcacatataatagtttttgccttcctccattatatttctcctttatccatacacaatctgtaaaataggcaatttggcatgttgctggaatcttgtaatacatcagcaccacaatttagattattccaaatttccattgaccatatactgaacaacctttcagggaaaaaagtaaccgaattcaatgcatttacccagttgttattttatatcattgcctgataaatgaatatattgggggaaatatatcaaaatgtgttataatcagcatagaacttaccatcaagccattgttggctggctactttttcagttagggatgtggatggatatatttgtggataaaatttgtaatatatataaacagataaaagatagacattttcttttactggatcaaagatcacggatttttttcaatccacttgataaacacaatgataaatatctaaataagtatggatgaataatttaagcaatttttatttttgttaataaaatggtagagacagatattaaagtatatcagttgttttttattattatttgtaagaatcaaacacaatcttaagaaatttataacaactttcacattttgctcgatcacttgagttaaactcgttgatacattaaagtatttgttttactatactcgttaaatacttgttgtaataaaattatttaagtatttttgttaaaaattattttggatttgtgaaatttaaatattatattttattagcttttatttgaacttatagaattgaattatcttcgaggacggttcctggaatcttttttcattcttgggaatgttatttccaagaatattagattagaatgatatttttggatatttcaagaaaaatacatttgtttaattattaaaatttgattgagaatcttttttatatttccataaatatttttaaaatgtgtttggttcacattatttttttctaaaaatgtatgttatattactaaaatattttttaatatataaaataactcattatatacacctacacaataatacaggagatcaaatactgcagtttacaaataacattgaagaatcttataaatttttctaataaatttcttaaccacattttactattaaagaaacgaatacccttgtaaaagacaaacaacataaaaagacacatacaacataactttaaccaaactccaagtaaaccaaaaacacaatcgataaactgtcttcatatcaaaaaataaatttaaaaaacaactgcaacatacttgtcttctgtctttaaattcacaccctttgttatcaaagttgaacagtaaaatctgaaatactaacttatatatttagatattatattgagggtataatagaatttttacataattaatatgattctcatttcttaaaaatttatattttcatcctcttttcatgagaatcatctcaatataatattaacattaacatgaatatctcactttcctaaaaataaaagatatgaaagagtatttttcaattacctttaaataaatgtaaaaatatatattttgatctcctcatttctcgaaattcttaaaaaggatttgaatgaacaaacactccctaaagtttattaagttttgttttgaattcatgggactgaagcattttaatatttaaatttattaaaataaagtataataattaatataattgtgttgagtgtttaaataactttagttttgacctttaaattattttttaaagaaatggttaaaataaataaaaattatagttaaagcatctaaatatccacatatatttgcgaatattaaaaaaattgtaagatggtcgtgagtgactcttgttctatctccaatgatgttaagatggtcctcttccatctcctccgccacacccttcacctcttcaaccaaccgtactcctccaaagacacgtcgtcgttttcgggtggagtcgttgaagcggagttcgaaaccagcgtcggtggagttggtgaaggaccccaataaggacttgtgccgcattctccgaaccgaagccgccatcagaggcgttcagaacaaggccaagtcgtcctcccacaaacagctctggcccaaggcccttctcgaagccctcgacgacgccatcaaacgctgtcgttcgcactccgctctcgaggccagtaattaattgattttaggattaacattttctgtgtctgaactctgaaacaagtaattatgactgattattattattattattatcatttgcagatttttgcactccttcgtaagcaatactggtatcaaccacgatgccaaacgtatgcaaagcttttgatgatgcttggcaagtgcaggcagcctgaagaggcttctctgctctttgagatcatgttgtctgaaggccttaaacctactgttgatgtctacactgctcttgcaagtgcttatggtcaaagtggtctccttgatcaggctttttctactgttgaagatatgaaatcagttgttgactgcgaaccggatgtatatacttattctattcttatccgctgttgtgcgaaatttcgtcgttttgatctgattgaacatgttctagcagagatgtcgtatctgggcatcgaatgtaactgtgtgacttataattctatcattgatggatatggtaaggctggcatgtttgaacagatggatgatgcattgaataatatgattgaaaactgcaactcccacccggatgttttcacgctgaattctttcgttggagcatatggaaatgctgggcaacttgataagatggagaagtggtatgatgaatttcagctaatggggataaagccagacataacgacgttcaatacgatgataaagtcctatggaaaagctggcatgtatgagaagatgaagactgttatggatttcatggagaagaggtttttcactccaacgatcgttacatataatactgtcattgaggtgtttggcaaagctggagagattgagaaaatggatcaacactttctgaagatgaagcatctaggagtgaagcctaattctataacttattgctcacttgttagtgcttatagcaaagttgggcgcattgacaaagttgactcaatcatgaggcatgttgaaaattctgatgtagtattggatactcccttctttaattgcataattagtgcctatggtcaggttggcgacttaaaaaagatgggcaagttattcttggctatgagagaaagaaaatgtgaacctgataacatcactttcgcttgcatgatccaggcatacaacacccaaggcatgactgaggctgctcaaaacttggaaaacatgatgatttctgccaaaagtagctttggtatgttgtgctatttgctctttgataccttttctatgttttctatgcttggtctgtcctattgtgcttggtaggaaatgcctaatctaataagccttccttggtattcgagtgcatgcaactattgtgcaggacaatgttagatgcctattagtgttagtctgtaagtgatatagtcagctagttaggttgggctgagactggcaaagaaataaggcataatgtaaaaatcatgcaaagaggctctataaatctatatatgctgttaatttatcaggtgtattcatcttctcaaacttgttatgcgaaagtagcagttatgcataggtctaaagggaggggggtaagtgggttgagttaggcattctgttttgtatcaatgtaaatgaggaattgctgaggcatgtgggtggaatatagttttcttctagtccttggaaggcagaccatttgttctctttgcctttatatattttcttgttttctgcaatagtaatgcctgagttttgcttttcactagttggttcattatcccttgaataatttttatatcatcattcatcaacacaccttacccaatgtttgatcaacaggcactaagttgattggatgctagcatagataattgtgattcaagacttaacaattctactcatggggatcctgacttggaaatctttgagaacttcagcaggtaagcatagattcttcataagtacattattattctgaaggaattttttttacccgtcaatttggaagtcatttactgtattatgttcagaaaaacatagcttcctagttttattcatagttagttggattaaaaaaaaaaaaaaaatccattaaaagcattgttttcactgaattctctttttccttcttatagctccttatattctactatgcctaaaattcacaagatagaagcctgtataaactgaatgtatgcttaagtctgaaatgtaacccagtaccttcaaaacactttcatagtcatcaaaggtacctcaaaatctattgaatactgtatcaagcagccaattgcagaaggtatcctttgatccaaagaggatgcctatcattcaaatagaattccttctcttggggagcaccctgttttgttcttttcaaaggaagttgttctttcttttttgtttcatattgaaatcttatgttttggattttaagatgattcctttactggttttcaatctaatcagtataggtgaatctctcttgagcatggaaattttttagtctgtatgtcacctgattttatcaccagtttcaacttttaattgtactaacatgcctttgtcatgttaagtacacaattgtttgtcattgcctgaaaaatgaatcaggaagaccccaaagtttatttcataactggttggtccaataactttgggttttgtttgagggtaaaaagtgggagaattttttgggtagaatttttaaggaagtgagttttatagaagtaatatttctttaggggggatgattttttttaccctattattagggtgaaacttcacccccaataattattgttctttctaatttctcattctcttgatcgccaattgtttcttcccgtgtatcaaatgcgtctgtgctgccggggtgacttttaccaatacagtcttttgcatcatcacccttaaactttgctgaatttggacatttgtgtttcctgcagggaatctatagatgatatagcattggagtgcacgttgcatgaagatataaaaaatgttgggtttattatcataatctgaagtgtagtttcaatcatcaaatttggcgtcctgcataccatcatgtatgcaactcagtcaaccaattgggttgggtgttcaattttgaaagacagaatacgataccagtgctttgcagtctatacagctcatacccacctcgcttaccgatgttgcaatgtgccgtatgaatgtgttgttgcagcccaaattgccattaataccgtagcgtatcatgaaaaatgctagtaacactaacatttttcttttgacatactctcttctattgggtgaaatttatgttggtcccatcaaatatgcaagtctcttctcatttagtgggtttcgttccaaaactagtaggacctacatgaattttaacaagtagaaaatagtgttacaaaggaagtgttggtgttttatttgcacttttctttataccactaaaagtcctcaaagcaaatgagttgtgcaccaagtaattgcatagtttgtcaataatgtatgaagtataataaagttcaaccattgaattgttaaataaatgtgcttctctgcccatggatttgtcattacttgaatgtattattactatttagtgtaccaaactcttttttaaggtaatttaaaattattttctgttttgagggtaacgtggcataagtcatcactctttgccaagaaaactcattttcattgccatgaatacttgactacaatgtcttacggagggagaggatatcctctgaggaaagattatcaaattattattaaatatgttgttaattttttggattaatattattttgcatgctcacaaggaacacaatacatttcatttttcttcgtttatgcttttttttcttcataaagcagcacaattttttcaacaaaaaagaatgttgttcataacatattcattttgatcattgatttttttttctttatgcactgaatgcctagtttgcaatggtcaaattgagagggtcatgcaagcacaacacctttcctggtttgtgtctatttgtatttataatagggtctatcttgtacaaatttgcacgagtttaaataggatagaaaaatcttatgcacacttgcacaagtttgccctggttaaacatcattaattattcactttccatcatttttaactaaccgattaattataattttttgaaaaacaactatctctcatgtttattattacatatgactctttaaaatttctttctcttctcataaaaaaaatcttaattttttgtaaagctcctgttaagtaagtattgcatcgtagcaagaaataaatgggtaacgtgattcttaaaacaatgttgttctccagggagaagagaaacaagaaaatgactaagagaaaataagatttccaggccatgttagctaaaaggtaaggaagtaaaagtgtatgaaagattgccacaaccatgctctttttatatgcaaggattacttgtataaaccattcttctataggtggatgtgttgtttggtaattggtatataatatatgttttcttttttgagatgggacggtggaaaatttccatacttggatggactttcaattcatcatgtaatactctttgcacttgtgtcttttaatcaatgcatttttaatttgcctaaaaaaattacgtacattgtgtggtttgagttttccatacttttatcgaccttcaattcatcatgtaatactctttttatctgtagagatggaatacttgaatgcactttatgaatgatctcataaatttgaaaattcatttgcctatatctttatcaacttttatcattaaatcaaagttgagatatgtttataatctttgcatcccattctaatttttatttctagtccattttttggtgtggaggggagacagtaagagaaaatattgttgttgtaagttgcagacgtttgtcccacaacagagagggtcattgccgaagcccataatgttggcgtaacaatcatcgaggtcgccaatttggagatagtcgcaaccgaagcagaagtcctcgatgatgtcgatgtcggtcagggtgagccgctcttggctgaagtagttgtgggtctgggaatcgtccagatagtattggttgtactcgcatggatgtgtgagtgatgaacaacgtggctcatttcctataaccgatttcagttgagtgtactgtggagcttgacattcaacttcctaataagatgaggactccactctattatagtttgcatctttctgcgggtaacaatcaatgcagttgagttttcactgagtccaagttatgttactccctgtgtcataggcaagtgtatggtccttctttggtgtccctatatcaaccaccacaacatagttcaaacttcaaagtattaacaattgaaacacgatagaatggtaattcctcccatcctcattgtcacgcctaaacctggactcgatgtaatctactctgcttgtccagattcagcacatcaatggctaactaagctctcagattaagatgggaacatggcccctctttgtggaccaattccattgatccttttcttttcaaacctgaagcaaaaaattacaaacaattgttataaatttgaatttaaggggataagtttgtgtctagtttgtgatggtcaaattgagaggtcatgcaagcaaaacactttcctggtttgtggctattagtattcatataaagatttttctatcttgtgcaaacttacacgagtttgcacaggttcaacataattaattatctactttccatcacttttaactaacctattaattatgattatttgaaaaacaactatctctcctacttattactacatatgaactctttaaaatttctttatcttcctacaaaaaaaaaattaacattttgtaaagttattattaagcaagttttgtatcgtagcaagaaataaataggtaatgtgatttttaaagatttttttgtcatactattatagaaaatcttttgttgtgcaaaattttgccattttgatctgattgaacgatagtgagattgtcaacacaacaagtgttgtaggtgatatcaccaagaacgacgtcactgagaatgatggttttcaaacactaacttctaacttctccattgcaacccatttctttcccttctttgctactacctttctaacgttgtcattgttagtgatggtgctttcattggtgggagtgattgtagccaatttgtgtccgattgcaatggtggtgaaggggtgcctagtgaagggtacttatgtctttacatgtcttttgggaggggcaggaatcaaaagtccagatttgatttaatggattcaccaaaaacagaacagatttattggaccaaagtacaacgcataatcttttttgtggcaactgttccattgaaataattcttatctcatgctgccacagcatatttatccaaaattattatggtatctatttttccccaagcaaaagaaacacttcttggttatgctggatgttttataattacaacggaaaggataactacaaatattactttggtaaaaaaaaactaaatgttactatcaatacccatgttcttcaagaatacaatttcacccgtaagcaatgttaaaagaaagaacagaaagtaacgggaagaaaacaaaaatgtccacatgactgtcctctcacttctgaccaccagcctcagttggttcaaccacctcagcttctacagtttctggggtatggggccggattaccgtggactggaactgaccaggtgtggaccatttaccagtgagagccatacccatcatctcatatatcttccctccaagttgtgctggattatcaggctgcacaccaacaaacaaccaaaagacacaaagtttaggatttcgcaatggaaacttaaataacattcaataatatggagccatgagtttaccgtaaaaccactggaaaccaaagcagcatcatacaaaagatcaatagctctgagggcatcttcatcgtctggatttgttttaaatgcatcctgaaaattatccatcaagattacgacaccataatttcaatttgtaatcattacaaagaaaagtggggattatctatttatcgtacatccaagttcctgataatagaatggtcagggttgatctcaaacacccttctgctcctcatgaattccaaactggatgcatcacccatagattgtgccttcatcagcctgcagtaagtgtgattaatactgaacattgctactcaaactttcaaaatacataatttaatatcaaagaaaaaagatgacaacctttccatgtttgcagaccaaccaaattttccagacgcaaggacacaaggtgaagagctaagccggtttgaaatttgcacacttgcaactttatctcccaatcgtttcttgatccagtcacatgtttggccaaattcctgcttcatttccttttccttttcctcattcttatcacctgcaaaaagaacaaactatcaacatcaacaacatctttaactcaagctaattggggtcggttgtagatgaacccaatgatagatacaaggaggttttaaaaaaaaaagaagtggaaggggaaggggaggggaaaggagaaataagataaaagaaagaacaaactatacgtaacaaatttgaacattaaacaagaaccaagctacgaattcacaccattgtcaacattaaaattagctcaaaagagagactaacaaatatttggttaacaaaatgcgagtttatgttcaatcaaattattgaaagtttaaagaagaaagaagttaacctagatccaaagtttaaagaagaaagaagttaacctagatccaagtcttccttgctaatgtcaacaaaattcttttccttgtatgatttaagattttgaatagcaacttcatctattggatccaccaaaaacagaacctggaaaattacattacaaaaaacaccaatatatgtatattaatcgatagaactaagtactcaaaagttaaaaaactaaaaaaaaaaagcttatacttcaagatccttctctgcaagtttctccaagaaaggtgtgttctttgcactagtcacactgtcagcagcaatgtaataaatatccttttgatcaggtttcatgttctcaacatattcatccaagctgatcagttcttcatcactttgggatgaggaaaaacgaagcaatggagcaatacgtttgtgattctcacggtcttcaatgcaacccaattttaagtgtttgccgaagttctcccagaacttctcatagtcctgcatacagaacaagtcagtcagtaaaatttaacaggaaaaaaggtcatccttttaaaaagagcttaagagaagttatataagaaagatcaaaagccactgataggatatatataaagttgatatatctataagataaagccacctcaatttatcctagctcctctacaacttaaagaaaaaatgaaagcaaactgtatacagttaacaattttcaaaataattatatacctctttgttctcactcatggatattcccagaatcatgtcaaaagctttacgaacaagacgtttcctcataatccgaaccttcaagcaccacggagtaaaaaaattaagcaagatgaaactggtaaggaattttatgagtgtatcctaaacgagagattcagatgtaaagtgtaagaatatgtgtgttgccctatctacttactatgcggctctcttgaagaatttcccgtgacacattgaggggaaggtcatttgagtcaacaacacctttgacaaagcttaagtatcgggggaactgtttaagcaagcaaaacattagtgaaggataaaattatcagaacaccatccagttattcaaggttgtagatagcaaagtgcttataccagttctccatcaaaatcatctgaaatgaacactctcttcacaaaaagtcttatattcttggtcttgggattgattatgtcatcctttccagagggagcgaaggcaggaacataaagtatagatctaaattctacctcaccctgcaataacaaacatcatccacacatttgtcaataaaaataaccaacacaatattggttgtcaaattaacactatgaatctcctatggacattggagaaaaattgatgttctcaagctatgtttttcagctgaactcaacaaataaaaaaatccactacacacaacaagatggcacttgagacaattaaattcttacctctgtggtaaagtgtgatgatgctaatggctccaggtattcattaaaagttttcttgtagaattcattgtactcctccttagtgacttctttaggattacgaagctgcataaatagagtaatgccacaatcttcaatcgagtaataaattttcaatataattgcaaatcatggaattggaaatcataaaactcacccagattggttgggtgtcatttgtcagctcccaatcccagtaccgctcaactacagttttagttttcttctttttctgtcataacaacgtgtcaaagactcagtcatgagtcaatgagtaaatttgcagaagctacacaatcacactttcacattcaacaaaatacttgattcagcatatatgcagaacaatcagattgtcacctcagtcttatcatcttgatcatcctttttgtcttcagctgtatcgtcgtcaacttccacctggaatgagcccaaaaattaataaaagctcaaaaagtcaaattttacaatctagaagggacgaacttaacttaaaatgaaaataatacggtcatcgatactgctatcaaactgaaaaaatctggattgtagagccatacttctttggtgtatcccttttcctgccatgtgtatattggaaatgagacaaattgtgaatagtttttcacaagcttctcaatccgctctggatgagcaaagcctttgtcgtccttctgaaagatagcgataggcaaaaagaaatcacatttttaattaatctcaggaataaagaaaactaaaaaatatttgatggtcaaaaaaggaaattatcagcatgccttaagatacagtgtaaggcgagttcctcttcgaatcagcttctctggatctgtctcctcagatattgtatacgagctagcatttgcctccccttcccaaacatattgcttatcagattttggactctttgttgagacaaccaccttcaaacaacaaaaaattatataaataccatattaaacaaaaaaatttaagagcatcacatatttacttttacaaaaatgcatacccgatcagaaaccagaaaagcagaataaaatcccacaccaaattgaccaattaagttgttgtcaccaccaacatccttgctatcctttagagccttcaaaaactttgcagttccactttgagcgatagttccaagacaatcaactagttcttgcctagtcataccaatgcctgtatcactgcataaaaaacataagttgcagcaccaactgaaatgacaaacattaatcatattcatagctatttctcttacgtaatactgatgatcccattatccttatcagcttgaattcggatatcaaaatcaactgcgtccttcaacagtccaggctctgttacactcagaaaccgcagcttatccaaagcatcacttgcattgctgcaaatgaaaatgcatagataaatagcttgacaatgcagaatttcataacattcaatcaataccaagacacaggcttctctatttttggatttttcaactatctttttggaaatacttttccttcaattacttgcagcatgtctgcaggaaatcatacatgatacacaacaaccacaacagcgcttaaaaagggtgtagataaatatatttgcaccaattaaacacaaaacaaaaatgctctatcagacaagaaatatgcaaacactactcaagagcaaaagagcatacctgataagctccctaagaaacacttccttgttactatataaactgttaacaatgaggtccatgaggcgactaacctgccatagccaaggatgcatatatattatcgaaagttaagttatgctcatgacactagactagacatgaaatagaatacctcagcttggtactcatatctctcggcggccgctgaggaagaagattctgcagcagttgattcatatcgtttgccaaagaacaaatcccttttcaagtttgaggaatcaattgtggatttatcagagctcataatagaaaaccatctagctgctttggtgtcattttcacccacctgtgactgtgattgtcattcgagaacatcagtaagttacactacataattaattaatgttatctaactgaaaaggaaatggattggtagcggcgaaagaatagtagggattatgatatgaagagtaatttgtaaagcgaagagagaaagaaatgagcaccttagctgctaagtgagaagaggaaatgggagcaagcacgttccggcgaagtgcgccgccaccgtagcgcagcaaggcagagcgagtagtagtagaagaagagagtctctgcatcatattgaattgaattgaactaagagagagagagagagaaactgcgtttgtttgtaagaaaatatggtagtagggttttagaaggggtttgcttgcttcgatcgaaaaatggcgttttggaagcttctcgatgcagctcgtttccacacttccctcaacaatatatttcccgtttcggtttattttcttttttcatgcctcgtttcttttttacttaatttgtacgactattataatttgtttatcctccttctaagtatataagtgttcggaattctttattgtaattcaatatatttttcattttcataaaattaaaatatattttttaactcaagtaagtttagataaatttaaacttataaaaaatattatattttatatcaattatatatataatcaacataaaagatattaaattgttatattaattatatatatgtaaaaatttatcatcctaagtttgaatttatttgaatctatattatataaaaaataatacattttaattttatgaaaatgaaaaacgtattataaattttacaaaaataaattttaaacatttttcatattcaatgaataccaaaaatatattttagcataataataataatatttataaattacatttttaatcaaaactttgattgcgatcatattcttgtctcttgagagttgagaccaattttctttcaaaataaataaaacaaagattggaaaagaacatctcattgataaatgaccatggtgggagaaaggaggctttcgcaatggcccaggagtccaggcccgttagcattcagccaggcccgttgtcctgtcggttatatgtcaagcagacaaaacttggttgggtggtggatggagtctatgattattgaattggaggcataagtttttcaataaaagttcgaagaaataataaaattagaaaaaagaggcaccaacaatacttagtgtacagtaaaaaatcgaaagagtgaaactcaaatattgtatatgtataaatgtataatgcatagagttgaaccaaaattggaattgcgaatcttatataaactattttagtgtaaaaggcttgcttcctatcatacttaagaatgtaaaataatccaaatgtattgagattgtttttttacaaacatttagtataacagaaaaacaagccaatttgaaaggctatcattggtaggcggacaagtaagcatcccagtgtgattggggagagaataaggtaggcgctgtgaatcaggctattcgtggatatattgaattgttaacatagatctattaagagaatcagagaattactgcacaaccttaaatcacatacaattttattcaatcgtaattattcaactagatcctcaacgtctaagaattttcttaagagttgtccactaagcaaagttttcaatagttttagagaaatatctttggtgcacataaaaagattaattaatgatttatttgtagatatttactcaattcttgtaattgattgtacttaatgaaaaaaaattactgttagtgatgtatcttaaattttgaaaaatgtttaaatacttatgaataaatatcagaatttagttgttatttttaaattcaaaatattgccaaatatttttttaagaattataaatataataagatatcatcagtatggcatgtcatatagcttctacctttttaatttctgaagaatatattaagaaatatataagtccaactaaagccaccttgggatactgccaaataaataaagagcacaatataattgtcgtgtttgtatgtctcaacgcacgtgtttagacataattataagtaggtgatttgatattggagtagagcatgataatttcatatttctacaaaatttatttaaaaaaaatgattttgatcagtatagcaatcataagtaaaaaaaactaattgcaagtttggaaatgactacttttgaggaaataattactgcacctattttagttttctcgatgaaaataaatactatttctttaaaataagttaaactaaatacatataatttattactgattttttaaaacaatttaaaagctttaaactttaataaatatacaataaaaatgtttaatgccttttagctgtcttaaaaacatttatttttgttttcaatgaaatgcaaaataatattggattaatgtgaatggatcaaattttcaatcttatgcaaaaaagaaaaattatatcagtatatcactaaatcacagttcatatatgcgtgtatgttactttaggtagtacttttttgtaataaaagtattaaattaaattatacgccgataagattattttaatttatatcaatttgtcacttgataataacttacatacgagtttatgtaactttggtactacccttttcttctctaaaataagagaatacaaattaaattacagtagtattaaacatccaagatatcaaataccaatttaatatttgaagagaacacgattctgtgaaataaagtccagctacaattgagttacgttcattactgccttcttgacatcgatcaagccactgcaaagtactgtattctggcctataaatatgccgagttatttttgtttaggaaaggtcatatacaattactaatgtcatatgtcattcacataccttcaagggggaaaaagaaaagcatcactgatacaaatcctccttgattattgatacaaaatgatggagatcgaacagagggttattatgcatctattatacaaggtactagctggggaagcaaattaagacaaacagtagtaaatatatttacagatgaagggaagtatcaacgtctgaggtatcaaaatttcttgatgttgatgctccctgtggccataaattggaggatggaggtggtttcgtgttcatggtgttgtgatgaccaccttgtttgtttgtggagttgaggccaagagaaagagagtcatggagggttggcctatgtggagccaccaaccttggttgttgttgagagttttgtgatgatgaggaggtggtctcagatgacaagagtttaagaagttgtttcccctctcttctttctttcaccttctccaactgtctaaacctttcttgaagaagagcaatggaggagttcacagtggtaggactaggatcattaccttgcctacccatttggcagtgagtaaaattttcaatcaggtgtcttctttatattttggtggggtttggcatgtagtggtttggaagtgcatgtataggagataatcatttttagctgttcatcgtttattttattcatttggctccttattgattcctgatgatagcaacagagattagaatcgactgctgttggagaacatgccaaatagataattgctaaaagttagtataggggaaagcagggtcgctggatgtgtggccaaagggactttttgaaggaggaaaagggtgagaggtagagtccaaattgatgatgctgagtagcatttggaagggagtattgtggagaataaatggttaggtaatgcaatgcttatctgggaggagatggtacttctttgtttgatcttgctggtataatacccctcctttttaataagcattaactgttgaatgcactattcttgttttggagctggagggagagtgtggtgctgtgcacaagagacaaaaggaatagagaaggaatatttttggagtttgccatcaatgattaaattagtcctaatgtagtgtccatgaaggaaagacagacaactcaatctacggtgtaagcatatgttttgtttaacgatacactctagctacttttaaattctagttatagttgtaataaatttccatatttttccttgtggattttgggttgatacaaagccataaagcttagttttgtgaaatgttaacctggcaagttgctaaattcatgtctcatttttttcatctataacctgtaactgtaacttggtagccttcatacaagtttgtgtttggaacgaatttgattgtttcttgaccaaatgctggattgttcaccattcttctaattaacattgagtctttaggaaaggaaaaatttgaatattgggttgtgaatgggttcagtggagctaacaatgtatatccatgatgggattatctttaaagatgagatattttttgcaattttaatggttgtggtcttgtggagtatcaattggttatatgcaccaagttgtggtctttgaattgatttgtgttttgttaaatgattttaaatgggttttgatttgacttgtaaacttggaagaaatgagtaggttaagtgttagaagacaagccatgcaatgattgtttctcttacaattgagtaccaattaaagaatgagtaagaatatggctagtttagttggatggtaaagttggatataaaatttcatcacatatcttaagaatacatgcttatatatgcttatatgcttaatcaattcagtgaaatattaacggttacggttagttattcgaataaacattaaattgtaagaaaataaataataaaaatgaggagtaacttttttactctttaaactagaacactaaatccgtgcaaagcatcatgtaagataagagtctcagtcacacaatataaaataataaaaataaaattagagaaaaaaaatctagagcttttataccatgtaatatactatgtaagggagaaacaaattttactattttacctaaattttcttgagtaagtttttcagtcaacaaaatgatctatatgagtgtgtttgggatagcggcacaaattaaatcatttcaataatcaattataatcataatcaatttttgtttagataagtttgttgaaaggtgattttcagataagtaattataagattaatttggtaattaagaaagaaagaggagaggaaaaaaatcgtggatttgaattctttcattaacaaaaattaacaaattactcccttcatctcaaaaagacttatatttgaagtattttcatacatatcaataaagtaagtatttcaagaaaattaatatatattatgagataattttactaaaatatcattgttttttctctaaatttcaataaatgtattattaaatttttcaaaacagtattatttattacaagacaaaattggaatagatatttgagtatctccttgaaaaatgaaagcatcaattaatttgaaatttttttaaaggctacgaagggagtaataactaacattgaccttaaaaaaagtgattttaagataattataataaaaaccgattacaaagatactccagagatacattgaactcagctaaacacaataactaggcatgttggtagaaaagtaccaatcattaaatgctctcctatttccaacaaaaaggtacagtaacgggtttttaaattgttgccgggtcgttgatcacacccaggaaatcatctttcatgcagaactgcaaaaaaaaaaaaaaaaaaaaaaaggttatgcattatatcagttaaatgagttctaaaaacattgaaactgaaaatcagataaatattcaatatccaaaggaaaaagtaatttgtatctctttatttgtcattttaaaaacatgacagtgtcacagttcatatctatagtcaatacaaccaaacggaaggataacataggctaagcatgttcaggagtatttaaactttattagcatacaaactagtatcatatgctcgctaaaacttccattaggctacaaggccatagacaagtgttcttttaagacatgttcacacatggcatacaacaataatcttggcaggaacaatacagtcaaacatgtaacatcaacaatgtggtaaacataatatcattctcattgcatgcagtaactggagaatttgtgatcacaattttctcacaacttttgtgagtcaaaacgttcaagattttagaaatgaagtaaagctgcaccatggaatagtaatcattcttgcataccacaaaagcacacggtaaatttataactccctcagggtagcaaataactttgcttggtagtaaccctaatattccatgtggataacttttgaaatggataaaatttaaatagtgataaaagagttaccaacacagtaaattactagctaacggagcataaactagcattcctcaaatttctttactattataaattcctccacaaatttcatgatatgcacaaatactagggcgaagccagtgatcatgagctaaatattaaaattagcaaaaattaaaaggctcttctgggaggaatttataatagtaaagaaatttgtggagaaacaaaagctatatttgccactgagctaaaaatgctttcctattcattcaaatttctcaaagcagaatttagcatatagctaggagttataaggttgacttgtaggtgaagggagaagggagaggtggtgggttcaaatccctcccactaacattctaacaaaactaacaactaacatttgcctatataaaaaaatagaagaagcataaattaagctaatggagcttaacaacattcaacaaaatgaagagacataatatatatagaagtacaatttcagtagcatccactggagtcccgattatctttagtctcacttcagtatctttttgaatcttaacttgcaaaagaccaattgattagtagtaaaaattatcataaaataaaaaaaaaaaaaacaagacaaaaaaaaaaaacaatttgctctcttcttttccattgaggaagttataattgagatatactgatccatctgaagtagtgtaatttggcatgtctccagactggaactccatatcacccggaatcaactaagtggggcaaaaagggtcataacaaacaaaaatatatataaaggtaaaagtacaactacaagttgaaaattttccattgcaaagtaatggcatattctatcttaaattaatttaaaaaaaaaaggaacagaaaataatcctcggtaattctaaacattaccaatacaaggaataattggctgacaatgatcatcttttaaaaaacaaacaatacaaggaatttttcctgtgtttatgaaaactggaatcatgcaccgcctttttctatttggccaatctcaaatttgcacaatcatctctattctggccccaaaactgttacattaaatagttacagaagtccattacataattaagtttcgagctgaataattcatttcatggtcaagatcttcacgctaataaaagtcatttatcttggaaaagaaatcagataggcataaccttaacccatgctgtatgggtacaaatacaggtatatgataaggatacatcccatataacaatacataataataaataaatatatatatttaaatgaatttatctacatgtggtcatcctatcctagcccaaaatcctgtcattcccactctcccaagcccctatgtgataatttggaggaatggaggctcccaagcccaaaataatcatgtaacccaaaacctcatttataatattttgacagagtaaaaaacttgcattgcattccaatagcaacaataataaataacaaacataatattggctttcaaaattgaaaacttgcctagcattccaatgacaggaacaataaaggaaaaaaaattaatattcaaaatgaagaacaatagtaacaatcttttagatatataacatggagataatagagaccacttctcaaatattacaaaagacaaaaacttacgtggtttgaaacaatgatttggacaggtccagcttcagcaaaaaatcccatctacacaaaaagaactcaacagtcataaaccaaaatctccagaagttagagttacacagattgattactctaaagagaaaggaactgtataaaccttgttcaccatggtaacaacagcttctatgttttctatcacgaattaagcctggaaatggtctgaagacaacacattggtacttaattggaaatgtcacaaaccctgttccatcacaaattaagccttttcctattttttctatccctgtaaccgccaccacaaatccatgtctaccactgcataataattgaaaatccaaatgttacatccatctaaggtccaaatcagtcacttaaggataaatacttttctctgatctaaattatgtacggtccaaacaaatgcacaagaaaaattactcttattaacatgtattactgggtagtgggtaaaaatcaaaggctcatgccagagggcaaggatgagatgaagggttcttaactcagagggaattgagtccttgttacttgaggttggggtattgtgattattttggtgttactttattgcaattgcagatgtttctatcttgaggtggcctttcaagtgtacttttatttcatgcttcattgtttctttaagtttaacaagagagagaaacccaagacaaagttagcacttattcattgggtaactgtctgctaactttcacaacttcaagcatcttgaaaagcttatcattgtcaaaggactcaagttaagttcagggagtgtataagagaaatagtatggttaactgattaactcgcatatttcatcttctttcccattttagcacaactcattttctagtgggaaaaaaaaatattgaaaggatcttaaggggaatcacctgcaagtgccttccacatctttcattagtttggaaataagattatcacgaaggttacaaccaaagtagcgtggatgcagctgcatctttcgctccagcactatgtggaaaaacattttcgtgtttcttcttgtcgctcccttcttgcccaatctggaaagctagttacttactactggccaaaaaacacagaataagaatagatttggaaaatacaattaaaaaagctcaaatgcatgtattagaatgggaagtaatgcatcactaatttttattacaaaaagtaatattaccacatacaattacgcagaacccactagggtcggcctagtggtaagggattggaatagtgtgcatgagatcataggtttgaatatcagtgccatcattatagacacacaacaacaaaaatatacaattacgcatataaaactgacaaatggaaaatccaatgaaagttatgttcaatattcctgattgcactgcgaaacaaagattgttacactaaatgccagcaacagaacactgaacaaaaaaaaaaaaaaaaaaaaaagccttttaagactctgctcaagcaaacaagcactctggatccaaaatgaaggacaaaaaaatttcaagctttggcacacaaacaagaataaccggaagagaatgcacatttgtgatgatgagcagttacagtgaacaagaagcagaatccagaagagaagccataataattttcaaaggaatgagatgtttagctatgttcacactctcacgtccacgcagaaaagtgaaaacggtaaacttcaatttgagtcacccttcccgaacctcgagtataatccctaaatcccacacaaattgtaacttattaatttattcaattattaattatatttatatttaacagaaatttaatttattactaaattaacattctttttttgtaaaattaaaacaatcaacattgaataaataatccttactgattatttttcttttttatttagcatgataacagaagggtatttaaattagattactacaatagataattcactagggtcaacttataatgaaagggtcattaagtttaagtagtttgcaagacagtttaggttcaaactttatttttgtgtacaccaaaacatatcgctgcaacccagaacttttaatttgttgctttacattctcattggttccgataaaaaaaaaattaaaaaaagaaggttagtattgagaaagaaattggtgtaaaaaaataagtaattcatgatttgatttcacaaaaaatgggagattaaaaaaatctaaaatcgtatactatttgcattctttccaaatgagtaaaaagaaagtggtaagcaagagtatgttgttttcttgttttcaaatcatagcttttgcattactcccttccccttcatcacttctttgttttttaattttctcatgactgactacattattgacgcatttagatggatacattgaatgcccgcctgctctttctcttgttctgggctttggatgttgttggtaatggaagatggattcattcgtttatggttttaatcatggttttgaattggatggtgtacaaggcacgtacatcactaatagatagattccttgaacatggtttcaatgtttgaactaattaacatatagggaaaggtggttcctgttatgggaagatagaaaacaatatgtaaaaacacaaaccaatcaatattctgaattccaaacgtaagagttgatattttctggggacccaaatttctaatatataaaaatataatggttctcatacagattcttctgctacacaggtgtagttacattagtgaaaatggagttaaacacaagggaactgcaaaagggagcagaagattgcatggaatgttggcatcctcattgtccagggacaaagttagtggcataagcccaagcattgttggcaacaggatcagcaacgtggtcgtaaaggttctgaatagggcccttgccagtgacaatagcctgaacaaagaaaccaaacatggagaacatagccaagcgaccgttcttgagttccttgaccttcaactcagcgaatgcatcagggtcatcagccagaccaagagggtcaaatgcaccaccagggtagatagggtctagtccttcaccaagtggtcctccaccaactctgtaaccttcaacaaaccccatgagcacaacctgaacagcccagattgcaaggatgctctgagcatggataaggtttgggttgcccaagtagtcaagtcctccctctgagaagatctgtgaaccggccttgaaccacacggcctcgccgaatttgacaccattcttctcaaggatctctgggaaggtgcagccaagggcaccaagcattgcccatctgctgtgaatcacctccagctcccggttcctggcgaaggtttccgggtcagctgataatccagcagtgtcccatccgtagtcaccagggaattctcctgtcaggtatgatggaatctgctctgagaatggacccaagtacttgggacggtcagggccatacctgttttgtttttcacaacacctcatccaaagtcagttacattctcagacaaattgataaaacctagcttcatatgtgttagttagctgatgtttttttttttttttttttttttatctttataagacaagacaataactattattaatctgttatgcttacataatcactggctttctagttagccccatcctgctgagaattgttaagtacaaaacatagatatagttctatagatgcttttttggagttttacctcattgataatcttaacatataatgcgaacttttgttacatgaattagtgagttaaaactccagttttaattccctccatttcaaattaatagtcgtctaaagattcttttagatataccaggataaaataataaatagataaaaattaaaatgacaattattatagaataattttttttctcgtacactataattataatgggacggaagaagtagaacagaataccaaaaacaaaaggtattgcatctaagttttgcggaattactagtattaatttatgttgtcaagcgagtattatattaaaacatgtaatactaagttgaactagtggagtgggaagggtaatgttgagttaccaaatgctctgaggagcactcttgacggtgcggcgcatgttagtgcgacctttgccggcgccaccggtcttgcggacgaactcattgacctgcttgagagcagtttgaccagcgaatgctgattgctgaatagcagaggtggccatgatggttgtgttggctaaggctttttttctttggttttgttttgtgttgtggagaatgaagaaggctactacaaaggtttatagaagatcgtatgatattgtggatcaggatatgcacaactcagcaacacctcattggtcgtggatttggatgtggattctcatgctgatatttcgacatgctatagtggctcttcttctgccacgtggatgcaaagatctccttcctcagatgttttcgagagggtcgatgtaagccacagaattcaggtccaacaaagtcaagaaatttaaattaaaacttggaaattggtatggaagatagtttggattgggctgatgctacagtaacagtgcaaacccgtgagtgactcattacattttttttcttctttctttttttatttttgaaaaaatgaaaaaatttgtgttgctagtaaaaccacacagaaacacagggctagtagtgcctcgacctcaagaacacaatgtggcagctcatcttcgctacattacaaatttggtttcatgtggaaattatatcttaggattttagaagagataatgacctctttaatttggtgtcaaaatcggtctcttcaagcaaacagtttaaaaaattagtatgaaaaatcacgaatgaataaactgtacatggttaaaaagtcgttgaaaatagaaaaaccacatttgaaatacaaaatttataactattaacttttaaaaattatatctaaaatgtgaaaaaacccatctaaaatgtgaaaccaaacatactactagaagttttagattaaatttcaggacggtattggttttttaattaaccctcaatatcataatcaagaaaatttgtatttaaatgagaattacggtaattaagaaaaaacaaaataaagcagcttaactgaggttaatgttctatttaaatattcaatcacaaaaaattaagaaaaataaatatggtttaaatgaacaactgacataattaatagaaaaaattgatcataaaatattttattcatttttaaaaaaaaatatatatgtatatatatatatatatatatatattacttatatacaatatttcttaattatattactattataaattaaaaaatagaaagatattgaattttagattaaggcctcgattttataataatttcattaatcttatttattgtcacatacatgacaatttcctaaacataaagtgtcttgttgttatagattcaattttattatataaattctacacgtggtaacatgtccactatcgcattttataatatgtaactatttataattttaagttatcttttaaatagttaatatgtcgtcatgtatagcattgaccacgacaagagttcatatataaaaacacagttctttaatagatgatatttttcacagaaagtgtgaatgaagtttcattgaaacattttcaaagctcaaaatataaataatttatccactaatgatcaaacttcaaagctaaaggagtgcagttcatacttataaaaatcaacatcatcccgaacaccatctgaaaacacacttgcctgcatcatatataaaagtaattaattagcatatctgaaaggagttctgcaattactttttttttaccatatatggaatcatgaaaaacgaagctaataggtaacttcggcttacttgaaagctttcgggggatgtaagtttatttgaatttgtactctaaggcttcactttagccaagaaagtctaaactaatttagtttatcttttcattttctttatcttcatttgctatttaatttaatcttttgcctttaaaaaaaataactttttttttgttctaatcttttatcttttttcgttgtttctaaagtaagcttttatctatttcattctcgttgggtatatatatttttaaattttctctgatatttaacatgcatatgaaatttgcttaattggtttctttatttttaaattttcacttatattaaacatgcatatatagtttctactttttccatcttcggagacatgcaaaaaagttttaaagagagtatataaaagaagaaaaataagtccaactgagctacaaaattcatacggctaagctaaatgattcactttctacgttattattatcacaagactttttataaagcaaacttgacaagtgatgcaaaggatgggaattgagttatggagacattgacagaaacaagttctactgaaaatatatacaataatagattagaaacgctaacgttcacattaattctctgtagggaagtgatggggaatcaatgaagcttatctacattcggtagtacaagcaaatgattattctacaatgactacaaagaaaggaactgccacaaatgaatacatacattaacattacatatgcagcaacattatttatacactgactaaagtcgttgggcgtgtcaagttgatctgcctgctctaacgaattgtcatgttcatgcctatttgactaaaaattagtcctacagggaacagaatgaacatcagaattggaaatactggagaaagatagaacgaaggtgaagtaattgattctgaagcaatgttggtgctgggattgagaataactggaagaatattcttcaaggtccattcaaatacgcatgcaagagcaccaatcaagacgcagataccccatctcgtagcattcagctgcatgcaatctgctaggcctttagcatactcaatcaccagcacttgcataagaaaacaaccaactaaggccaccaagaaatagaagctctgaacaaccatcttcagaacctggttgttgagaaaattgcagagttggcaaaataggaatgtgttgaagatcatggtttccctaacctttttatccttgccagtaacatgtccaccgaactcaagtatcattgacacagaagtctgatataaaacctgaataacaatgtttttccagatttctttggttataatatgttggttcctataatcagatggttgtttagcaatccgttcctcgccggttagcctcaataccatcattaggccacccagaatgcacatcaagacattcacccaaatcaactgggatgctgcaaggggggaatctccagtacatgttgtaatcaaggttatgactgaccctgatatggtacatgtcagctgaagttgaatgaacttctgaatattgtggtattgacttctgccagccatcacaattggttccaatacactgaaaaatttgattgttatgtcacaactatctatatccactattgttctcagaggatcaagaactatccccacatcagctacctttagaactgaagtatgattagtcatcaaccttgttccaatgaatgcaaccaccttacctttctcttgcaagcactgtatcatgagaagtttgtctttaggatggaagcttcccattacatgggctcgatccactttgtctaatctagcttccccattcaaatcccgaagctcttttccttcaagcacattatcatgttctagtcctagtccacaagctatgcctttcacttccatgatgccatcctccgagaccagtttgatctgtatatttgcatcattttttttcagattttccaaagctgattttatggattctagactagtagtgcatttgagacctatcagtcctaacaagatcagttcttctttctcaagttcttctccatctgtttgtctataagcaaaagcaattggctcaaggccaccatcctccatctcttcaatcacctgcccaaatttgatcttttggttttccatggcatggcattcccctatactatcatagtacagtgaacacatatccaatattgtggatgcagctccactccagtgcatgtacagaacttgttcattgtccccaatttttcttaccaaaactccgctaccttctttgccagaattcagattgctgtgcttaagaatgtcaaatttctcttctgtgaaagatctcaagttcacttccaatgttgtttttgcccaagaaacaagtgaattagacaaagaggaaagagaaatctctggtgcaaggactgataaaccaactccttgtttaagcatgtcaagcgcagttttatctatttccgatccctcaaccatgctgacatctttctcccccatccatactctgctaacctccattggtttagatatgagctcacctgatacatcaatgcagatgacagttaccaaccccattgtcgtactagctgataaatcatttagaacagcatcttggtttggaactaccttatccatctggtacttgagagaaattgtaaccacaagtggcattccatgctgcacgcatagtattgcaacagtgacaaggcgtgttaaagtggaaaccgttccttggggtctcaagaaagctctctgaagtgccttcatcaacaagccaattgagaccttccccttcatttctggcaacccactattgttcccatcttttccacatattaggcgaacgaagaccacaagtaaaaccagtagagagataaaaagagcagctatgtcaacgtaagaaattggcttctcgattagttgctcaaacaagcccctcctttcagccaaattggtgttggttccaactgatgttaccaccatccttccctggcccccaatcacctttgaaccagatataagaaacgggttccccttaggatcatgtttgctttttgttgcctcaggctcagccagcataaggatgccatcacttacaagcaaaccgtctgctggaacctcatcacctggccacaggcatactctgtcaccaaccacaatattagatatgggaaccattacgatctcttcacctctcttaaccctgaattgcaactcgacctttgtctttgccaatttcaacattttcctctcacgccaaaagtttgctactgaatttactacaaccagtagtaaagcagcaaaaactatagcaacaccatcatgccaaccatgtttgggtccctcctgcttgaatcctatggcgaatgacaacccagcggagacgaacagcaccaaaattgtgcagcggtagaacttgcagctgttgaaaaaaaatttggacaagtttgttccaagaactggtaatggtatagtggtcttgccctgttcataaaaacaaaatcccatcaacaaaacacatctatctcaacccaccacaaacaacagttagtagatccatccttcttcacacttcaataaaccgagaaatttgatggtttaaactagaagggatcctccaaatatcataaccaccatgtggatgaaaaaacaaaagaatcactccctctttaatgtttttccatgtagtataggagtttagcaagaagttgttggtccgaatggaactgagctcagattccttaaacaagatctcgaattcgagttttgtggatgaaaaaacataattgagagaagatatctcactaaaagtgatcagtcaggttcttttgtagaaattaatcatcagctaagttggtgaatcacacctataacatgataacccaagtttcattatttttctttgtttttattgttgaagaaaagggcatgaatatgaggaggggagaaggttgatatatacctttgagtattgatgttgacgaccaaggacagcggaaacggagtcaacgccaccaagctcattgagggatttcaagtccttctcctttacaattcgagcaatatcactcctaatgtgctcttctctttcttcttcttcttctatatcaattgcaactgaagatttggaagaggaggttctagcaggaggtactgaagtgtacggtactgaagaaagtagtgatcgtggcgactcatgtttgtcggtagaagttgttgacttcttgactgagatgaggaatcttatgtataaacttctacgccatattctggtgtacttgctgttgccggtggtggtgaggagtaaggtagcaccaagttcaatgttggcaccaccatcaccaccaccagctgaggacgaggttgcttgggacatgtcttaaatatgtcacagttaatgagattggtttattgataaaaagaaaaggaagaaaaagaaaggtgacacttaattcgttatttggacacaatggttgattggactgtaattcaaccggaacaaagcctacgtttcttgttctcaagatccaactagagggttttcagacactcatatcatcttgcaattacacacacaaacacacacgtggtttaaacaaggaattatgttacacatgatggggttatgttacaacacggaacaagtgtcaaagacagacactatagagaaaggttagtgattgctcaaattagattttgatgatttcaagccaacaaagaatggtcaatttatagcgtccaacttggatcacgtagcaaatataataaaactcaagggtatcgctgctattaaatgagtttttatcatggatcaatgggaatctgccacgattccaaggcataaacgcgtacgtagcagggtggagaaaaagtggtttgcccttgcccttgcccattatacgcaaatttttatgttcaatcttttatcggccacatgccggcaacccccacccatttggaaattataaggcaatttactattaccaaatttcttcttcacacgtcatttgcatggtttctagaattctttcacgatacattgcacgcccaaaatagaataaacaatatttcttttttcattatgacgttggtgttgtgaatttttttttttctgattacctttttttttcatttataagaataaaattttactttaaaaacgaaatctaatttcactcaaatcaataagttgttagtaaaataaataatatatacatcaatggtgtgtaaaattttttcggattgttatttaatcacaaaatattatcttcacaaaaaaaatcacaaagtagtattatatataataaatttgttgaatttttatgataattatttttaaaatcatattaaagatgatttataattaattgatagtgttcaaatttatacacaacaaatgttttaaggaaattattttaggttttattttgtcggaaattaaacatgcgtggaatttcaaagttaaggatatattaaattatataggactccatgtcatggaattaatttttttcttaaatatgcctaagaaaaaactacaaactgttaaattaaaaaaaaaaagccctaggaatttgatttactaaattgatattttgaaccgtaaatgaaaaggaaaatgaataatggttttggtttttgaaaatttaatacaccatttctaatttatcattacatatttattagggtataaataagtgcggttcactcataaatttaaattgacccaaatcaatccaaagaatttgggttgaataatttttgtatttaaatcagactcaatatcaaactagtcaaattttggattggatcaagaattttaatatttaaactcgttgacatgttaattgattgatttgagttgatttttttttttaaaaaaatcaatcaatatcaagtcatttaaatttgatttgatcgctttacatcatttgaaatttttttctttaacctactaaattttcgtttgtgatttaaatccgtaaataacttcttgactaaacctttgatgccagcttcaacatgtcattagcatcatgtcaggtattattaagaatacctcctcgttctaccattttacatataaaaaaatgataaaattttatgaacgtagtacttgtccaatcggcatttaaaaaattatatataataataataacaacaataacaatatgggaagaaaaaaaaaagacataaaatttattataatataaaatatatgaggtcatcatcatgtagtaacaaagattttcactattaaattctaacacgtatgtgagcgtagattgttttcttatatttagtactttagttttcagttaatttaatattctagataatgatttatgtaataagtcaaatctgcaatggaaaaaagcatgctggcctctatacgttttggactattcgatctcatttctcagccttctctcaatctaagataaatacaaaatttattaaaaattacaaaattaatagtgaaattcattgaatataaagggaaacctacaaatttttatgattttcaatgctaatctttctcccaatcccgaatgagaaggtagattgaaagttctttacttttctttttttattatgtatgctttttggaacagtaatgacataccaacattatattattttaaatattttattaatatttatattttgtttatttctttttatcatatctcctattaattatatatatatatatatattaaatgtcttcaaatgtcaaatagattcgtgctattcacatttttgtttgttaaaaaatcatttttgttttgggaatagggagccgtttcttatgcattatgaattagggcatgtttgcattaacttctccaaaagtatttattagagatgcaatgaaagaaaaaaaaaaaaaaaaaaaaagcttttccatgacattgtgaataggtccacccctaaattttaatttcatgagataattaaaatttattttataaatttaattattattaaatttatgtcaaatgtatttaatttgtgttttcctatttcttttcttgtgattttgttctttctattttaaaaaatccataattttgttcacttcttaattttatatagatttttttacactttaattaattggattttttttatgatatcttaaataaatatgttaaatcttggactcaaatagatcaaaataaaagaaataacacatgcaaaattaagaattgaaccaaaatcatatattttctaaaatagaaaaacaaaaaaaaaaaaaagaaccaaaattgtaaatcaataattaaagtggaaccaagattacaatttaatctaataacaacaataaagatggataaaaagaagtagagattatatacatatatgagattatcaagtaacacgtttgttgcttccttatctttactaatttagttttagtttatttaatattctagataatgatctatgaaataagtcaaatctggaatggacatcaaaagcttgctattcttctaaaaaaataatcaaaagcttgcaatagtgctggcctatacgcgtttggactattctccgttacgtctcaatccaagttaagtgtcagttctagcttacacactctaataaataattgctatatgatcgaagtgcttggcattgctttcttttgaaacatcctttaaattgctgcattctccaattctcatctaacttcatttctcttggaattttgcttgaagaaataagagttttgttttcttggcaacatgttatgggatgataattgcacttatggagtcaaataagtacgttttaagaataaatgtttaaattatatcgatctcataagtattattatacaaaatctcatcaatcaaatcgtttttttctaaaaaatatgagacatctaagtcatccaaataaaacaatctatttcttgataagaaaaataaaaaaaaaaaatgtgaatggtgattgaattgatgataaaatagaattttgtgaagttcctggttatcctaaatggcaactgactggattctatggttatcatgaacgtgatagaagataagactcatggaatcttctatgtgctattgcacatacttgagtgattggtgcatttttggagatttcaatgatctactttcaaatgaaaaatatggtatcaataatcatcaaaattgactttttagaggattcaaagagattatcattgattacaatctccatgacctttctatagaaggttatacctatacatgggctagaagaagaggaaagcatgatactattgaagaaaagttggacatagcacttgcaactgggcaatggattgataatttccccaattttaggctgctcaacacaatatcctcaaagtctggtcattctccaatcctactgaggcttcatggcaaaaattctaacatttttggagaagatttagatttgaaaatcaatggtcgatggacccaaattttcaatatttggttgaaaatagttggacaatctctttgtccaatgattttcttactaaattgaaggcatgcatagaagatacgaataatagggggaagcaattgcgcctaaaatatcgtgctcaaattgataaatcaccaggaacatatggccttaagccaacattcttcaaaagattttggcatctccttggacctaaagtgcataaagttgcctattcttggttataacaaggtacattccctccacaaccattcttttcatcccaaaatgtccaaaccctaccaccatgaaatattctagaccaatcaccctttgcaatgtcctttacaaaataatttcaaaaatcttagccaataaactgaacccaatccttccaaaatgcatctctcttgaacaagctgcttttgtataaaacaaatttataattgacaatgtcctgctagccttagaaattatccaccacatgaaatgtaagactcaaggaaaagtggggacgtagctttgaaaattgacattagcaaaatgggatttcatgaaaaatggattggttggatgaatctttgtctcacaactgtgcaatattcaatcttggtaaatgagaatcctattggaccaataactattgggagaggactaagacaggtgactctctatcgccctatctcttcatactttgtactgagagtctttctagtctaattaaaaaatatgagagaacaggagatattgatggtgttaaggtgtgcaaggtgctcctaccttttcacaccttttatttgcttatgattgttttctgttttgcaagactcaagaaaatgagattaatactttgaaacatatcttggacacttatggagaagacttagggcaattaatcaatttccataaatcaggagttctctttagctcaaacaccttagataaatgcaagcaacaaatcttagtcacttgggtacaacaaagtttaggagctgaaaaatacctgggtctaccatcaattgtgggacggaggaagaaagaagtatttggttttctaaaggaaaaaatgtggaaaaggatcaatcactggacaagcaagaaattgtcaaagacgagtaaggaaattctaatcaaatcttgtgcacaagcaattttatcttactgcatgagtgtatttcttcttccctcttcactagaagatgaattgcaaaaaatgatgaactagttttggtggggtaccaaaaacaatatgcagaggagtatcaattggatgagttgggacatattaacgattaaaaaagaaaatgggggaatgggtttcagaagtctccatgctttcaatttatctatgctaagaaagcaagtttggaaatttatttcattccaagatgttattgttacaaaagttttcaaagccaaatactttcaagattgtttttctggatgccaaacttgagcataatcctagttttgtctggcgtggtatctttgcttcacagagtgagataaaagagggtatcaaatggagaattggaaatggaaactaaatggctatttggaaactaccatggcttcgaagaaatgactacccatatgtttctacggctcaaccccaaggattagaagatatgcatgttggttctctaatagatcatcaaagatgttcatggcaagaagacttcatggtggaagtcttcaatgaagttgacttgtaggaaattagaagcataccacttcttcacgtgctagaggaagacctgcgagtttggaaattcatgccacatgaagaatattttgtttgcactgcatacaccatgccatatggagctttggagaatgaaagttcctcctaaatttaagcatttaatctggagaattctgaggaattgcctcccttcacaaagtagattgagagataaaagagttctttgtccactcacatgtgaattttgtgaaaacaacattgagtcaagtcggcatatcttctttggatgtgattcagcaattgcaacttggcaagaagcaaaactttggcccattattcagagcaaagttttgtctgtagaaggtattgtccctctcatttttgacatcatcaactttctacatgaaaaggacccatgcaaaaaatttgctactgcactatggcgtatttggaagcaacgaaatgataaaatttggaggaatcaggtccagccaacatagatcacgattcaacaagcatttcaacaacttgaagaatggaagcatgcaagacagcagcaatcccagtcacatgtaatgcagattttaaacaatcaatgtgagtggaagaaaccatcttttggatacttgaagtgtaacattgatgcaacaattttcaatcaagatcaacagtttgggaatggaatgtgttttagagatcacaatgggcaatttattcaagcaaaaacaacatggtttcaaggtgttccagacccaatagtagttgaagcattcggctcataccaagccagggaatggttaaaggagagcaacaacaacaataatttttgtgttggacaacaggcttgtggttgatggtttcaacaataacaacaaaggtttatcatatttagcttcaattctcagtaagtgacagttctaattacagatcgtttgatgacaggtggaaggcgtcactccaacaatggaagataagccaaaggaagatgccacaagggtgatgggcaacccctaatgagtctaaacgggttcagcatgaaacctaaataacattctcataatacataattaattgtctggaaattcaagtttgtccattctattgcaattttgtgtacatacaggcaatcaacctttaattattctaaatgcgcaccattaacgtcaattatgaaggctttaatttctagtggtgcacatgaaaagacatcaaggctatcaactactaaaataaataaaaaaacgaaaaataaaagaagtataactttatttaattctaaaaaaagagtcaacaacaccctccatctcatgagtctttaataataatcatgcactgaaataattttgattcaatgttcttcaacgcatgtacaacttcaagaattattgttaccacttgttgtaggatctcctctgcctttctggctctgatcatacgttcttctagtccttctgttggtccttgaacttaattgtcctcatcattaattgtagggatctttttaatttctttaacaactcattagggagttttgtaaagaggccaacaattttgtggctcattgtcttgcaagaacatctaatttgtatgctagctcttatgtcttctaccaaactccattatgaatgaaataatatacgtctgttcctctataaaaattactataagaggggtacaaattgtttatgcacgaactaggtgcatttattaaaattaaaaaaaaaataaaactaggtcatttcattgttgtctaagaatagaagatttataaataatccatcatttagatgacaagttattacttatttccaattttgaaatagacacctgcacattttgaaatactcgttttcattttcagttaatatgttttcattgtaatgataaaacaccatcctatttcatattctcttaacaaaactttatcaacgtctatttgcagactaaacattagtttttttttttatgttttttgtttacaggattagtatttgatgttatttatactgacatggtgtaattaattgcgatttcaatatcaacaatgttatttgcaaggcattttaattgcgccattctgacacgcttttgttttgtattttttatatatataaaaaatattaatcacaacctttttcttttaccaaacagggtttccggaatggtgtgctaaaatcgtatacaggaagcatctcttttaatatttgcggatttgtacttgctgcatatcttctatccaacaccatttaccaatatcatccaggattacgttgtgattgtgaatgcaatgcatggaagagaggagcgaacaaaaacaactgcatatgccacatgtcatgtactaaacctacaccaacttggattacggttaaggaatgatccttggccaagttattccattggggaaggccctgcttcaattctgatgtcaccacaatgctcgctaccaagcatgattgccattagcataagtttgcctgcaactggaaaatccttgtgttgcatcaagattgtttcgactgaactacccatatcccccaaaatagaagtctccatgttttcttgtctcaaggacaaaacttggtcaaacccttcttcaaatgtttcgctttgaggtccataacacctacttgaagcctggaaaagtatagtatttttcaagttttgcaggatttcctggtcactccaaccttcagttctgtacgaatcatggaatttactccaatcgtcctgactagcagctttcttccaacaatcctccaaaagttttctgtggatcttccgaaatgaggaactagtccatgcaaacacatcaaaggccgacaatgagagttctcgatcttcaccttccaggcacaatttaatcaagtcttctggatgaagcagctgagcttcaacaagttgtctatcttcaatggaaggatgacgtttcattaattcctcctgcaggtaaagcatctaaataagaaagggtaaagaggactcctaaaagggtgcaacaaagcttatttgccagcgcaaggttaaacaagttctcatgaaacaaagcaaatattaaactattaattttattgtcatacagtcacataacactcaatgccacaagtcagtcaatttgattgtcaaacgtgtattctttacaatttaatagcatgccaaatccttcagcaggctccttattttccctccctccaaaactaaaactttttataattcctcttcaatttcatgaataatttaacttcctacaacaactgtcacatcaaacccctcaatcatgtatttaacaacttattttaaagaagaaatttaaacatagttataatattatataaagtataaacttatcatgcaattatatttgtctcatgttattgaaagttatttgtgatcgcaaaatctacccagttcaaagagaagtttttatcttgctacaatataattaactattaattatactttataatgttggtctttacaacgttgttaaaaagcggtcatggcagcaccatggtagattacaggttagatttctgacaggccaccattctatggcagtggcatggtgggtttttgtggcaggctatggtggccgccatggttcagccatatgccacaacaccatcaaccatatttttttggcagatttttagctggtcaatagaagccaccattgataacactgcgtcttaaaaggggtaagatcataagagaaaaaggtgggagtaaccaaaatgagttcaagatagattagtgactatacaggaaaggacaggatatggaatgagtgtagatgaaaagatattggtgtgatacctatcaaggaaaagaacacagaaaattggttaaagtaatttggacacttgcaaagaaagtcactagaaacacttagaggaaattcaagaaggacaatggaggaaattaccaaaaaggatctcatcataaatagaaccctagagaatttggtttctaatcaagcagaatagcatcatgtgagatgtgatctatagttgacctcacctagtgagataaaatttgttgtcgttgttgtatttatatcattatatgactagaaattaaaaaagcttatatacaaatttagtccctgtaagttcgaacttttttcaattttgtccttgtaagtttttttttttttttttttttcctttttagttccttaagattgcacttttcaattttggttcatgtaagtttttttgttcatttttagtctttgtaagtttgtgctttccaattttattcccttagagcacaaatttaaaaggactaaaaacagaatcttaaagggactaaaattggaaaagtgcaaattgacagggactaaaaatgaaaaaaaaaaattacatggaccaaaattaaaaagatgcgaacggactaagttcatatataagccaaataaaaattcaagtatttttagtaacaacagcatctgtttgctcctaacatatcaagttagctttcaaacactggctgatgtcctagagtttcacggatgcctaatactcacgatgaatgattgagaaaataaatcaactccctcttcaaattatcaattgttcaaaaataaaaactcaaatttacctgtaattttagaatcttcaaatcagcctcaatgcggtccaccttgacttgagtaccagcatctttaccagctgttgaacaaaaaaacgtaatactttttatttattgcaaatgaaatttattaggtatctattcattcaaagaaaaattagatatttaactaactaaacctgtgtccagttgaaacagtacatatagataaaaaagagagagagagagagaaagaaatcagaatataaacaccaatctttatccaatgacttgaataccacaaccaaatgtggacaagatataatgcttggtcacatgtaaatatggaaataaatcatgagataataatgaaaaatgggaagtaatcctaagatactccaaactattcaaagatatattcaagatattattagagatttttaatatattctaacacagattaaagatttctaagaatctagatattcaccaattcgcaacaataagtaaaaaggcgacattaggttgagttggtaactgacatatcatataaccaagaatccagcatattatcagagatagcagaaaacttaaagtagattgccggccattgagttcaaatactccctagttagaaggaggaagacatctaaagaaatattaaatagaatgaagagaaaggaagtagtctccataacacatggaaaaacacatggtgccatacctgcaaaggcagcaatcttagagagaaataaaagattttttctgtcagtcaattttagtttcattttcatatactcctgttctccttcctcttcagcaactgaagtagattgcatgttttgtgagagagccaatgcatgaagtgtttctgaagcagaggaaaattgatgaaggaacaaatcatgaagccaaagaagatcgggatgctcccttaggaaaatggatagctcttctggaaattcttcccctagccttaaaagttgagaaaattgtcttctttcatggagtttcttaaagacatagtaactaaatcccccattaggtcccaggctttcatgctgcacacaaacaattgagacataagcaagaatacatttaaaaaaaaaaatggcaacacatagtacatatagaatccttgtgattaaataataccaaatagaaatcataaattatcattttccgataaccaattttgtgtgaaaggccgaggttttattcaacattgggaggtgtcagcgatgtaattgtaaataacttatttatactattactagtactaactcatttcaggtgccgtgtccaaaataagacacttttatgggtatgtcttgtgctctgaaagttcataaaaataattggtgttgcattgtgcttgtgtgatggtgaagaacatggtcaaaaaaaattcgtatacctggttaacatttgtttgcacaatctttctttggaagctctttccaataatatataaaggcttaaattgaaagaaagaatatgtggagctatacaaatttggtagtactgtgaggtttgttgttggttcttaattaatagatctttattcatttaaggggcattttgtgtcctagctctagctctaggtccggatgtaactgctactattgcttccttatggacttaagttttaggagtgcaattattttttctcagcagacttctactcaatcctaaagccttatcagtaacggaatatttgggttgataagctaagaaaatcatcattgcaatttgcaaatgcctagaaaaaagggaataaaagaaacatcagtgcacaatgaagaataaaatcatagtcataccataatatttctcagtaattccgagtcattcacatcacaacaaattgtccacataactttgtagcatccatgtcgtttagcaattgataacagatgtgaagtaaccttcattatgtcctcttcattctgctctccagctccttcaatcaaatcctgcacaaaagaccaattgaacaatgtatatctatcccacaccaggattgcaaggatacggtaagcaagatagaataataaccttgtgagtatcttcaaattctttaactttttggtagagagattcaagaaggctatctcgcctctcccaatattcatttaacagacctttgtgttcttctccgcactcatttttagctgtaacagcaccagaatatgcctcaagtagaacttcagctagggcttctaaatgattatacagatctaattttgctgttttatcaagtccagatatttcatttaacaagtgaagcaggacagaagcaacactccaaataccagtccgtacaacaggttgacaataccaaggtgttaaaccttcaggtggtggataccataatcggttctcattcttatagttgaagcatgtcctaattatggtaacacatgcagtagagagttcacatgccctctggatctggattcctaacagatgctctggtcttataacatattctaactctgcatctaagcagtaaaagagatcttcaagatctgaaaccttactgtagaacacttcagcattatctctatccatcaaaaggacagtattccgacgagctctctcaccaactaattgtataatgtcccaaagggcacctgacatctgaatattcaaactagaatttgaggagtcaacattagttgatcgattttggctaatcagattttgcagttccctcagctgaatcattgcagataacttttcaccatgctccaaaataatttgtaaggcatgtcctgggaattgaaaaaaacatcatttagtaatggaatgtccatttgctgttccctaagtgttgttttaacttgcatttttacctgaaactataattatttatttcacaaccttaatctatttaatcaattaaaaaaattggctgggaaaacatgaccattaacaaaatcataaatcaaacatgccttcacttataatcccaccctaacaagtcaaatgacatcaagaattaagaatccatgtgctttaggatttcattcactccttccttacctaattaagcttacattatttttaaaactctatgtgaggctatggggaagaaataagataattaagcctcaattcatttagttgcagaataaacctccttcctttgattttttcatacatgctgaggcaaaggagcagatggatgataattgagattatattcatattcattttacccaatttataaaagtcaataagctatcagtgaaaaaccactctccatttttgcttgtgatatactttgtatgagatcatcctaaaaagtatgattatatctgattcattttattttataaaaacaggctggtagataaataaagctcatacagacatcacatacccaaataatgtaaaaactaatgaccaagttaaacataatcaaacaagtgagttgcatatggaagtattgtaaaagaaattgtttgaagatcaaatcaaaacaaataatcttttggtgaatagactaaaaatttcatactctgcttagaacatagctcctcgtggcatttggataaggcaagaaagtgaaggaacttttgatgtttctgctgcttttctaagagttgggttgaaacaacagccatggccaaaatctctgctcctctggttgttgtccaatgtttagctaaggtgtctatgattgatttgctcatccgaacaaaaacattggtttccccatccctttcaaatgaaccagatgtttcaagcttttcaagagacctatcaatttggccagatgataaaaaatcattgaatagattattcaataaagcttctgattcttcatctagagcagttcgacgtgcaatcccactcaaaaccgtcctctgtttgtctccagcactccatgcttcagagctagcccttctaggagcaaaattacctgcaaatgtaagatttcttatatctttttgtgcagatctttcatttgaactgcctttacgagataagcttctctcaggtggttccactcctccaagtataacagctttctctggtattgcccatattcctgctttctctgttaatacaacccatgcaccttcttcataatcatctgcagaaggaaggatagaagcatctagcactttcccagcatcataaggtaaatcaaactgataaagttgtgtagagtttctataataatgggagacagttgctgttccatccccagatattatgactgcagatcctgaaggcttgccccctatccgaagcctcatggaaaacaagaagtcttcgtcttcaactctagcttttggcattatcacctcaataggggcttttttctccaaaaccctgtcatttgtagtctctaaacccaaccctgatttatattgcatggtcaagagagagtactgcatgtagcttgaactgctaatccggtcattgcaaaaggttgcaacaagaatggtaatgactttaccatgatcatctacttgcatatcaagaggccagattctcttttgaccagctagatccttcttaatgccaacctcagcatctgttccaacaattgcctgagaccaaagcctagaaataggtatatcagaaccaaactctactctgaaacactgtatctcatggtctgacaataccaagaattgtgaatttgattcctgaatagaatgatgtggaaaacaccacgtcagagacctagggtacccaatattgctcacaatttgacctgattcaccctgttggagccggaaattttgatatactttccttctatgaatgccagtaggagtgcattgaaactgccaaagttcaccactcgagctacacacaagggcaacacatacaaacttacaactgggatcagcagaagcaatcatagagttaaatgtgtgcaatccactcaaactacttcccagcttactttgtcgccgctgcctgtcgaaggatgctttcccatcaggagtcataacagcctccagctcatcggaagacacaagactagtgaccggagcgtgtgactgagaatagatgtccggccagtatataacagcccgagtccgacaattgcacaaaaccacagcagcagagttgcactgtttagcaactttattcgttcccacaggcatggcgtcacaattaacaacacgaagcaaccaactaccagcatcatttctgccaacatcagcatcattcaaaggaatctcgaggacaacacatttgatggagttagcaggggacaaataactccataggtagaccctgttcccacaaataatccaagcaagggatgtgctcttgtcaatcccgccacacgcgtgatcttcagctgcattgcgttacatcataatctcaaacacatcaagcttaatttacttcaaatgtgaagggattaacacacgtgctaactaacacaattgagagacaaatcaaacagttctcaccaggaattcgcttgtgtagcaaaatgttctgctcatcacgaaccacttgcggaaactcgccgacgaaaacaggtttggtaggatctgtatcgtcgccttttccacttctgttgatctgaggaaccctacgcaatgaaaacggataacagttagaagcagaaagcgaatcgatgcagattttggtgaagaagtgaaatgaatgaatgaatacctggcaagaacagataagcgaggaacccagggagcgggagtgccggtggtcgggcgattgggaacggcgttatcgtggaaagaggttcgagcaggagtgaccggagaatctaccaccgtggaatcgcgaccttgctctctgcgagagcgaacattgctcttcttcgttccgcaagaaaacatgatgatgatgatgatcactcagtaccggcagattttagggtttatggggttttcgccatttgaatcacgagagggaaaatgaagaaaatgaaggaaccaaatatcgggttttactttttaagtgtaataaaattttcactcataacgtcttcatttttttgctaagggggaattctttctctttaggcacttgtgttcatgtaaatttgaaattataaagatgctaaaatatctcttagaataaaattattcaaagacaataaaaagacaggttagatgaaaaataatttataaaatatatgattatcttatcagtttcatatttaaaataagtataagcacacattatagtgttgatatcattcatacggaaaatatattctctagttaaaaggttatatatgacttaattttaaccatataagcaaaaattacttgttaatttgtatgcataaaacttacattttctgtgggtgttgcattgcatatatgaatataaattacactcataaaaatatgaatataaatgacggttctaactcactcattcttgtaaactcttgattattagttaaagtttatttaaaaaattataaaattatgagtgaaacttagtaaataaaaaaaaatctacaaaaatttataaattatagcaaatttcaactaataaaaaaaagtgttgaagaagcgcattattactcattagcatttgtcatgactagaactacaattgtcgactttaaaaaaaaaataaaaaaactacaattgttgaaaggggtcctaattttgtgtatttgctactgtggtattcattatcttaaaagcaattactattaaaaaattattatatgtaatttatttatttttgaatagccatgaccgtttttcataaaagtctctgcattcaatgcgaaaccgtttgttgtaacccaaagaactaacaaatgcgaagggatgaaataaataaaggaagccaatttcgtctgacgctgggttacggttcaagcagccatgtataagcgaggataatgaagcgtaagagcatgaggcagtgcctgccgtagtggccagtcactactcactaatgaaaggtaaatactttgataatcttgaattttttttatttttttttacgttttagtttttctttttttttttttttttttgtccttaaaatatctaaaactttaaacagtaaaaaatagttctttgaacaataaactattatttaaaataatttaaaataggacgaaaaaaattgcacacaaaaaatgaaaaaaaaaaaaaacactaaattataaaaaaaaaaaaaaatgtatttatgcagtacatataataagctcgtcatttgatatcatagctcaaaatttcattttcaagatgacaaatttatgaacaaatgattagaagaataaagataacgggtattggaacttgaagagaaacggcatatatcgtattttcgttcacatataagagaatacataattacacagcaccggaaattagtgcacaaggaccttctactgcataacagttcagttctccagaggagaagaaacaaccaggttttggaatcaaaagcaaaataaaataaaataaaataaaaaaaggggggctagaaaaagttctttcctatcttttgttttctaggcaaaaagaaatttgctatacgtacactggtacacatgcagaggtttaacttattgtattatcatggttccagcttcaaggaaacaactcttgattgtctgttggattttgcaacctttaagaacactgtagataggcaagccggtgcccaccatggccgccgcaccttctgctcccctttcagacaagccactacagacatcaatatagcattcacaagttaggagtattaacagataaagccatttttttcaactttaccgggggtaaacacccccctccctcccccccttcttttttatgttgttgtcacaagaaatatcatcttgcaagaaaagtcacaacacaacaaacagaagcagcatatgcatattttgatgtctccttatatataaacatatcacatgtttaggaatggacgtcttgacaatcaagttctggatgactccagcctatataataatatagggtttgattatgtttttggtccttttaaaaattcacaaatttcacatttgattctcatttttattatttttccaaatgagtcctccatagggcatgtttgttaccaaatgatttctttgttgagtttgatttatatatttattgtccatgtaaaacgattttacatacgcatacaatatgaatttatcctaacaatgcatattaatttaactcttttttatttttcccatttgaaccttcttaaatactatattacaaaattttcatctggtccctctaaatgagagaccaaatagaaaattctttacatttagagaaactcctgatatctccaggaatcaaataagaaaggaaaactgcacaacctagtgatattttttcatcaggtaaagaaaaatgtcttatgagaacattaatttgaaaagaaaaaaaaaatgggaaatcaaattggaaaatcacaaaatttttagtgtctaaaaacatatatataaggaagcgatttttagaaaatgtaattcacaaattgtcttgatactcacaatatagaaaaatatgtgctatgatgagaccctttaatggttgtctgtaatgaaatgacagcagtaccaacaacttataggcaagttatctcactctaatacagtaatactaaacgtctactctaatctttcttctagtacattcatgtttccttatagattgttcaaatagtacgaaactgattgtgacaacatcaatgatcatgccttacctaaccatggaaagagcacaaaacagataggtaaagatgaaaatttcaaatgagtttattgacaagtgtttttctgtttactgtttaaagggggaaggatagagagagagagagagacctttaatccgtcttaattccttgcacaatgtgatgaagtctccccacttcatgtggcaacgtcttataaaacgtaggatctgttcagtcgtaaacatggacatgccttccaggtattctccattaacaccattttctttaaaaatttggctgtaactaccaagatttatagtctccagccacaatccaacatcctgataaaacatgcaagataagcaagaatgcaactgttagtttaaattatcagttacattttgattctgccatggagatgcactatattttttttatttttttttttatcagcaaaaatatgtatatatatatatatatatatatatataaaggataaaacattacaagaaggaagtagaaaacaatccaggcataaagaaaccagacctatggtagcttaatacatgagtagggcatgaattaaactaccaaaagctggctggattgtgtacaacccttccctagatggagacgcactatatgatatgtctgtgtaacagcactcacatgttatatacaccaagaagaagaagcaaatccaaaagggtttatacaacaagcttagatccttgtcaacataggtctaatgtaatttgcacaattcatcatacagaaacagcagcataaatgaattaaaagaaaatatgtggaagcattccagagcttactacgttatatcagtaattaataacagtgcatcaattatactgtagagtctagacctgtataacagtgctgaataagcattattgaacactcaatacataagtagaaacatacacaatacatgagtagaatcataccgcaatcttgtgaccttgacacacacatcaaaggagaataacaagatgatacctctttatctgtaatagtttacacttcagatacatgaccttaataacctacttaacagagtaactgacaacaaggataaatcataagctggccacatcactgacagaggaacagggactaagggcataatcaagacaaataatatattggcaatctagtttcagatgctatttttccaaaacatagttgcaacaacagtgtttgaaaatccaatgatcacagaaagatgcatatagctttgcagtggaaactcatcaaacgaagatttacacttatgtttgtgctgcacaaaggagtaagtaagcattcagtgtaatctattattttctttgagagaataatgtaaaagccctcactttaaaatgatcatagaaactgtgagtgtcaaactgaagaattgaacaaagttatctggcaagaattggaaacttaatttaaaaaccagataacttgtgaaaacaacagggaggagatgagattcacaattaaatgaaataattcacgcacaagtttgattagccaattacttccaagttgagaaggacttcaacatcatccaccaaatttcccacttgattagacaatactatgttcaactttccaacatataaaaacaggtttaatctcagtctttacttgtgttatcggagaagcaaacgaatatcacaaaacagactatcgtggacaaagttcaagttatgtacccaacaaatttagttaaactaactgttgcaaaaaacctaattacatgttaaaagtacaaatcacgtaaaaagggatcacaactcacaaggcgtggttttttattatgagaaaatgtaaataaaaattaaaaaataaatacatcaattgacaaagggaatgaaatgattaacctcaacagtccagatgaagaaatcaagaggctccggtgactgtcctttgttcatttcccaaatcaaacttcctcaaatacacctgaacagagaccaaacaaataagtaaaatcccccaccaaaaaaaaaacagtttttctcgaaaaaatccgtaagaaacttttcccagttaagtaaacgataaagggtcgatctgacaaggagaagattggacaacccgctaaaatggaagccccaattacaagatctcaaggactaatttattgaattaaaggagaaataacaaatcaaaaaaatagtataaactaaatatgcttaccactttgcgacagtaaaaattgggttaagattaaaaaaagggaaaaagaaaaagatattctacgtttgatgtgaggaagaagacatggagaggagagagaaagtaagtgatgtgagaagagatgttaagacaggaaacaagagagggagaaggcttttttttcaactcagaattgcatgcttcgtgttaacgcatctgccacgcaccacgcgactccgttgcatcacaagccacgcgccagccttgccacttgctactcgaaaataaataataagtacattatttcctctaaattttgtgtaacattattgattaataatgtaattttgtggctgaatcatgactttgatgtttaactacctaaataaattttgcaaataagtctctagacatagttaagtgtcattaaacaaatgcagtaagacaatactagtacttctaaacaatatatattattttttctggttataagaaatatagatttattttcaaatgtattgattgttaattaattaattacttgtagtattttagcttacatattaattaaaatttataatttataataaataaatatttttttagcgtataaatttattataattaaaatatataatatattaattttttaacatataaatgatattttaaatttatgataaataattttttctgtgtatattattattttaattattaataaattcttttagtaaaatatttaaattcaagttagaactataaatattaaagatgatagattgaatgagataataagttaaattaaaccgttcaattaatatcaaaagtataagatggtatataaatgcatttttaggagcatttctgaattctgggcactgaatatacatatttgaaattgatttctcagttttaaagtgttaaactattcaattgatattaaaattttaaaacatagaaagatatatcatatgcattttaagatagtaaagttcatcatttcacaagaggagggtattaaaatggaagtgaatatgaggaagagatagagagacaaactagtcttaaatctttataataacaagggacttgatatatttttgtaactttaacttattacaaaatatattaatgagatattcatgtatggactttttatgtaattatttttgattaaaaattatttttaaattacatataatgtcattaaatataattactatttaaatcatttaattctatgagtatttgtgaaatgaaattaaaatttatgacattattaattaaattaactaacttaactattttctttacaggaggacgatagccgtgtgcatgggttgggtgcatgggttgtattattatcaagattgaaaattttcattgcgaagtgctaagcaggaaagtgtttctgtgagaattgaggtgttgttgatgagtctcataatgtggtttcgacgcatgaagaaatgttttttgtgcaaaattaaagataaataaaatgacaacaaatacatgtcacatatgcctttcttaattaaaaagataaagatcaaatgtcgatgattctttggtgaatgtttagctaaccaaagatattgtccatataatcgattttgcatgctgccccaaaattcaaggagatctttttttttaaaaaaaaatattatgtttaaaatctttgcaattttatttagatttaaatatttaattaatttgttttaacttattttaagaattttcttatttttaaagattacgatgatgataatatttaaattttatattgttatttaactttgtatattaaaaataaaaatcttaccatcttgtttatctaagatctcttaagtgtatggataattgttgttgtgtgtggaaaagtttttttaacattgtacaaattgattaagacatagaagacatcacatgtatctactatgagtttctaagtgaaaatccaaaccaacactataactgccattgaaaagcagtatatatgaaataggcttaaatatattttttatacctgaaaatagttttttttaattactacctaaaattcatttttggtcatatatgtacctggaatttttttatctttcaatggaatatatgtctttaatctcgttttgttaaatgataacataaaagataaagtgtcatttcatgaagctattacacttaacacatagccaaattgaaaccatgtcattatttattatttaatttattttaaaaattcaattaaaacaaatgggacttctccttctccaacggaaaacaacccagtgccatccaacctcgcgccaccactgcattgccatgaagatgttgcaagggatgcctcattccaatcacaacccttttgacccctccctagtttggtttcacaaagggtaggatcatttatcaactacaaaacacaaactaaagccccaacaacaaacattgtattcgtgagaaacaacaacaacatcataattgtaacacacacatgtgggtttggtgacaaacagaagaagaacttggagtagagcagagatggtgttgtggttgtcatggcaatcgttgggctccatgttgaggtaccagtggtgccgcggcagagttcgtcgacaatgttgacggcctagatctctgcgacgactgtgccctgggcatagaggtagccctcgccgacgactttgctagagagggagacgatgatgcaaccgaagttggggtgaggggaggtgaaggaagaaggagaagaaggataattgaattttttaaataataataaatgatatggcactaatatgttagtgattatgtttgatgacgtgacattttatctgccacatcatcacttaacataatgagactaacatctagtattacattgaaacataaaaaaaaaaattaaatacatagattatcaaaaataaattttaaatagtaaattgaaaacaatctatttttcaggtatgataacatatttaagcctataaaatatcaatttaaaccggctagctttcttcttggccaacaactaaatagctttacttgtgcaaatagcccaagagacaatcaatatttttagaagcaccgcaaataacaaaccaaaatatatttgaaatgaggagaaatagaaaagaaaaagaatccattagcgatatcatccgcggaattttatattggttgaacctccatatatcgtaccttataaagcaaagtgtgtatagtatttaccaccaaaggaatcaggaaatgattcgaaggaactcataataggttgttgcagttgaagtaatgatagtttgagacaaatgcggacaatgaaatgttttatagcatgtcattgagtcgcttggaaaggcttgctagttgtataaatataagagtttcaattttggaaactcaacttccttttctatttcatcaccttgttagttttcaaaaaatttcttcaacttggaggctccattaataatcgtaagttttatatgcagagtgagagatcaaaggttacaaattgtggcatggttatatgattagtgttggtgctagttttgggaatcatgaccgtggagaaagaagatttgacaatttctaattaccaatatcctcttcggtcacttaacactttgtttgtttcctatgaaagtaaaaggtgtgaatgtgaaaaataataaaagacaaatcacatatttgttttattaaagatgaaagtaaatattttaaaaaaaaaaagactcatgagccccacatacaagaaaatgcatctcaaaatgagatgaaaaacacactaaaaagtcattattattattttactttgacaaataaccctttcaagggccctcgtacatatggtgggccaacgagtgattgattttggatttgacatacagtcgattatgccaaatagatatcgattatatgcctttaattaaaagttttatttttttatttttttatttttacactttcatttattttcttacctttctatcaaacacaatgttaattttgggaatttacttatctacatatactctgacctggttttaaattggaagccacacaattgcataaatatacacataatcccaaaaatgacatacgacaacgtggactcatgtattaattccctgttttgttagatgaaaatttgcctcatatttattttatgttcgcacgtggacatgttaagcaaatatcaacgaattttaccaaatataaatttgttaaaatatatccttttgaaagttattttttttaaaaacatatattcatacttatggtgtagtgtagtaacactccatttgaaaaacaaaacacataggaatcaagctgctaatatcatgacccaagcccaataagaaaatggcgatgtttcaacagtggcgtaggcccaagcccagctgagccggcccactattgaagtctgaactcaagtcctaccatgttggttcagttcagttcaccctaaatttcttccactatcatcttctctcagtcttcattgtttgttgggggaaattcgattcggtttcgcaggcattgcctcgtttcgaaatccatgctatttctgtttcgttccttagaaaatgtgttgattgattcatagaaatgtgttttgcagagtagaatgtttgggacggcgattcgatgtttggcgaagaaaccgaagccgaagatgggacccgtgatcctgaaaacgccgccggagcagaggcagacaatcacaagaaccctcttcgatataattaaggagcatggtcccatcactgttgctaacacctgggaacgtgtccaggtactagtaccttcttagcttctctctcacattctcttcaatagtgctgaaaatagatataaacttgatcgggttttaggaagttggattgaaagatttgacaagcaagaatcacatgaaaatagtgctgaaatggatgagagagaggcagaaggttcggctcgtttgcaaccacgttggagcacacaaacagtttctctacaccacttggtttaccaagccggttacccctcccaagaatccctcttgaaagttgaaacttaatcatcagttggttgctgctgttttgtaccatgtcttgtcaagagtaataatttcatcttagaaccgttattcaatagagagaatctaaatgttttgccttattttccattgtttctgtctctgtgttcttcactcacaactcacatacctattaatgtgtgtttggatagcttctaaaattatcgtagattatggtaaggttgatcaatcttgattttgaccaaattttgcatgtttagattgtagaggaactttttgcaaccacgttgaagcacacaaacagtttctctacaccacttggtttaccaagccggctacccctcccaagaaccccctcttgaaacttactcatcagtttgttgcgctgttttgtacaatgccaagagtaataacttcattttagaaccattaatattaatagagaatctaaaaatcgggctttattttccgttgttttttcttcttcactctgttatttctgtctctgatggattgaatgatagtagaactttatgattctgaatttttccggagttatgaattttaagaaggctaaatcatcataaaaataaaagaactaataccccataaaaatagatttattaacggttaaaacatggagatcatatctattttcatgtataaatctcttgcaatttgatggttaaacttaataaagtgaaagaaggtgtcagctagtttatgaaaggatccagaatttaatgtaacacttctcattttaaagcattagtttgtttgggttggtgtgtgtttctggatgggtgaatatccttttttaggggtaaggtatgtgccttggtgcatgtttcgacggattgaaattacgagtttcatagatcatcatctaaaaaataaacttcctagcatcctcgatagtatatgatacagtataatatgcttaccagaattagaggtttgcatcatgtcctcgatagtagtcgttgaagttagtgataactttgaacaattgtgcacaagaaaattaatcacgttctgaaactatcccttaacagaaattaacgaggtttggctgttgtgttgagactacatgtttcagttttggaagcaaaacctctactcatacctgctacaccttcaaacacttgcatgcactggacgagaattttgagattgagagtgtgacaagatggagtttaaactgtttgggatttagaatttgagatattttcattttctttatcgtccttaatgatttactccagttcctctcaatgttctaccactaggacctttaacagaggtatcattctcaagacagagatgcggagaatgatagcctttagttttggacaattgcaaatgtgtagtttatgaagatgttgaacatgaaggctcaaaaaatgtttggaactcgtccatatataccttagctctggtaaattgaataaccttaatagtgaggacttctaagttctaaccgttgattggaaatccctcaagatagaaaatttctttgattttagaggtgttctcaataataacagatactaaattttgcttaatagtcataatcgttgccattgaatccagtaaaagcatattaattatgaaatctgatacaaatattaaacatttcacattttaagagaagtgactaaatagaattattgtcatgcttataaaacagatagagtcaacgttttagaactaatgatccgaatgggtaaattattgatagacagagtagacaactcagcatcgtttataacaagcagttgtaaggatgagcatgttccaaaataattttctgagcaaatgccgatcatatttggcaactttttcctaaacaggaaactcaatttaggacttgttttgacgttccttatccaatggtgtgttatagacttatagctgattgcaattttctatcttcagctcttttgattgtgaggtaggcctcctaagagcgctggaaaatagcatttggcttaaaatattatcttaaagctggaaaaaacaattgggttcaaagataattaattcaacaaaatatatatgtttattggtacatcaaagtacagttaattcaagaactgacctggtttaatgtttcttaaagtaaatgaaagaattgaactgttttcagcaaatgtataaaagataaagggacaaaatatttatctaaccataatttgcacaagtccaaaaacgataattatttccacagaaaatgctacataaacataaattgctcgcactacacgtcccaaaaagaattctacactcagaaactgacagtctcattcttagaagaattgcaaataacaccaaaatgtatatctaaggagaaacagaaaatccactcaaccaaagggtagggctagaacttccaaatcacaaaaagtcgaaacatttttgtttgggcatcaacaaaatcatcaagactctttaagttcatcttgtatgttgcgtagttcctgagccaaatgatcatgcatcttaagaagctcaccaattcgtgcttgtgcatggtccagccaggatcccttgccacaacacgttgacgcatttcatcaacatcatgacctctcaaatccaagttgaacagcttcattgcatagtttatggaactcgttttctctctgaggagtaacactaacggcactttcatttcgaaggaacaacaacatatctgccaaagtttccaacatccatgcgtgaaaatgctcactgaacttcacacaagcattccaagttgaggatatgctgctattgcctcgccagcagagcaatttgtgcatcatccagatcaacaaagtgtttatgtgctcccaatcttgtacaagtatttgcagaagctgataaaagtttaaggagtaggtcacatataacaaagcaataaaaagctattataagaaacaattcctattccctttgttttatccaataagtttgatccttcttggatttggatgtttttacaaagtgttattcctatgttgccttcattcagcttatcatcgttcaacaacctgaaaatcttgtgcaagtatgtcgctgccgctagactcagctgtgagttgccacaccactgcccaagctaatgctttctacaccagctgacaaagtgtttgctgttgctccctctgatggaggccccttctgaatgctttcttttcctatttccttaatattttgtgcatcacaaatgaataaaaatgtttgagccgctttaaaaaggtcagttgtttaataacgtacatcaggtgctggcatgacagtaatttgtgcaattttagtggttaccattgtttctccaagtgcctgtcggtctggaaaacctgcttcattgcttgattcttcatccaccaacttttatttgcaatactgaacaagcatgacaggaattagtcttactattaggaaatctattttcaagcttggtaattattaaactcgtatgcaaatgtatattatgtagagaagttgtcatataagttagagacgagcttctcacctctaaaatagaagttggtattgctagttttacagatgttgggacatttccaataatggttctctctatttcatcaacactctttacaatgccaaaagttatgctgatcagcatgctaactttcattgtggctattttaattacttccttcttctccatatttagtttactaatatatagttttccgaaagattaaaagaaaaaacatatacctctgtcatgtttggggaagaaatgggtgacaatttttgctccaacgtttgtggtaaaataataaatagaagtgaagtcttaccagattctgccagtaatgacattcttccgtgcatttttcccttctccaagcatccaaatcaaagaaattcattccataagtcgaaatcaattatacaagttggcttttgtgaatggaatgcaagaggtttggcttaaatgtactcttgccacattgcagttgtgtaattttgattctcgagtttcaattatacaagttggaaaaacaattgggttgaaagagaattaatttaacaaaatatatatgtttgttttgcacaagttaattcacgaactgaccccggtttaatgtttcttgaagaaaaagaaagaattgaactgtttctagcagacgtttaaaagataaacggatatatatatatttgcaaaagtcgaaaacaataataatatccatttgccacataataaaatgctgcataacaaacttaaattgctagcattacacgtcccaaagaacacagtagactcagaaactgatagtctcattcttagaagaattgcaaaatgtatttgtatgaagaaacagaaaatccccacaagtgggacacaaccaacgcgtagggctagagcttctaaatcataaaaagtcgaaacattttgcctgggcatcaacaaagtcattaagaatcttaagttcattctgtatgtcgcgtagttcctgagttaaatgattacgtctcttaagaagcttccggattcctgctcgtgcattgtccagctcaggatccctcgccacaacacgttgacgcatttcatcaacccatgacctctcaaatccaagttgaacagctacattgcataatctatcgaactcattttttctctgaggagtaatactaacggcagtttcattccggaggaacaacaaaatttctgccaaagattttaacatcaaagcttgaaatcgatgactacacatctcacaagtattccaaagatgaggatatgcttttattgcctcctccagcagagcaacttgtgaatcatccagatcaacaaagtgcttacatgctcccaatcttgtacggatatctgcagaagttgctaaaagtttaaggagtgggtgacacataaatataggatggacaagagacaataagagagcaataacctggagaaacctcaatgttgttattagaaacaatgcctattccctcttgtttatccatcaggttcaacccttcttggatttggatttcttgacatggcattatttcttggatttggaaatcttctgcaagtatgtcctttctactagagtcggtgagagtcataacaccactacccaagctaatgctacctacaccagttgacaacgtttttaccgtagctccctctaacggatgcccctcttgaatgctttcttttcctatttcctcaatattctgggcattacaaatgaaaatgaaaaaaaacgtttgagtggctttaaagttatagctatgaaaaggaagatgttttataatgtacatcatcatcatgcgctagtattactaatttgagcgattttagtggttaccattgattctccaagtgcatgttggtctggaaagcctgcttcattgcttgattctttatccaggaacttttatttgatatattgaacaagcaacacaagaattagtcttactattatattagaaaatatgttttcaaggctagtattattaaacttacatgcaaatatattttatgttgacgagttgtcatacaagtcagagatgggcttctcacctctaaaacagaagttggtattgctagtttcgctgatgttggaacttttccaataatggttgtctctatttcatcaatactctttacaatgccaaaagctatgttgattagtaagttaactttcattgtggctattttaattccttcctttctctccatatttagtttactaatatatagtttttaaaaagattaaaagaaaaaacatatacctctatcatgtttggagaagaaatgggtgacaatttttgctcgagtgtttgtaagtttgatgtctttttgttttctctctctgattcagggcactcgcctgtttcgaacacagttgctctgctttcaaattgcttatgttcacgtacagtttcagctatgcttccaagaacaaattgattgttatcattgacttgtggagtaggtggtttacttttggatgttgatggatcttctaggttcatttgaaatggagaagtgttttctggcacggaattctgctcatgctgaaaataataaatgagaaacaagttggactatgttcaacgattgattccatacaaaaatatgcacgtgcatatgatttatgctgagaagtaactaatgaccctgactgcgagctaattgattctaaatgagttgacctagtaatgtcattgcattttctaatgcaattccttctctgacacctctcttaatattctgcagaaattcaagaaatatgcaattttgtagcatactttcattcttcttgtaaaatgaaatgacaataagcatgtcagcctcaagccatttgaaagggaacaagcattggtccttgtttttgaattagaggacacaatcaatgacaattttctctgattgataacctttttgaataatttgttcattgggtttctgtagtctatattaaccatttcttaaatattcagaagaatgtgcatatttagttggtataacattatttacctgaggaattcctatggtactttcagtttttccaagtggcctttgttggtctgtaaaatatgatcgactcgttgattgcccatccaccaactcctacatgaagtgatgaattaaatgcttgagtcttaagctattcacttcttccaatatttataatagcttatggtatactcacctgtgaatgtgtttcacgttgacaaatatccaagggacttggggttggccttttattcagctctgaatttgttgaagttgcagtagcctgtacctctgaaccaggaatgttcccaatgaaatcgttctctgatttttcattaatctgatcaatgacaaaatatacaaaaagaataactcaacaagtaattttttttaataaatataatgaaattataaaaaacgaggatctttttcaattaattaagtcataacaaatgtagacaagatataatgaagcaatgacacgtattattatactgctgtcaaagtttcgtgaagtaggtgatgagttatccgatttgatgccattatcattgtgattgtatttaggtaggttaacttgcacagattggctggttctaacctgtgatgaaggcaactcactggtgccgctacttgtagaaacttcatctgattcaatcatattgcaaaacaagtggacaaagtccaacggtgaaagtccaatgtttttgaaatctgtaacaaaacattataaattaaaggacttcatttgacaatgaaacacagtaacaaaaatgcaatgcaacttcaactttccatggtagatcattatattgtcacaagtgtgtttgtaaggcattctggcagctaataagctacgctgactaacttataagttattctgacaagcttgagtggtaagcaagcttactttgagcatccacaatgggcaaaaaaattaaaataatgccttttaaataaaaaattaccaaaatatggccatttgaaacatatttccgaatctactgctgccaaacacgtctgggtaagacgtgttaaatcacgtcgagcttggacgtgttcaaacacgtcgtgggatggcgcgattaagcacacaaacacgtcctgtgtgggcgtgactttgcacaagacacgtcctgtatggacgtgattaaacacgtcatgcagggacgtgatttacataacaggaatccccattctctctgcatccccattctttcttcagtttttccaatccccaatttgcataaaagcttgctttagttttatagcttgtttgatcgtgtaatttcaaattattttgttgcaattttcataaattctttactatatgacaaaatatatgaaccaaaagtgaaatgtaaaacaaaatgattaataagatgaaaagaataaaaagatataataggtcaaattaattttataaaatcaaagtttaaaaacaattaccaggttatgtatgtatcttttatatcatttttttgtacgagggtatgtatgtatcttttgccaaaaaaaatattcagtttaagtaagattaatatgagtaatatattttttctttaatatttaacgtaattatatgtttaaaatttaaatttaaagcaacttattatattaaaatattattttagtgtaattagaaggtatctaaaatttctatttaacgcctaattattttccttttttatattcattttaaagtaaatatcttttgtcataatttcatgctgtaaaaaaataaactttagatgttgattaaaaaatcttatcatccgttagaaagatatgaaagtgaaagaaaaaaaataaagagcaaagaaaacactaattatgatgtattttttgtttgattgaaataaaaatataaataatggttgacttctaaaaaaatctcttacttgatttaatagacgaaaaataaaattatagaggaaaaaagtttgaaattttgacaaaatctcttgcaaagaggaaaaaatctcttactttatttttcgtctattaaatcaagtaagagatttttttagaagtcaaccattatttatatttttcttttactttctctccaatcaaacaaaaaatacatcataattagtgttttctttgctctttattttttttctttcactttgatatctttctaacggatgataagattttttaatcaacatctaaagtttatttttttacagcatgaaattatgacaaaagatatttactttaaaatgaatataaaaaaggaaaataattaggcgttaaatagaaattttagataccttctaattacactaaaataatattttaatataataagttgctttaaatttaaattttaaacatttaattacgttaaatattaaagaaaaaatattactcatattaatcttacttaaactgaatattttttttggcaaaagatacatacataccctcgtacaaaaaaatgatataaaagatacatacataacctggtaattttttttaaactttgattttataaaattaatttgacctattatatctttttatttttttcatcttattaatcattttgttttacatttcactttttggttcatatattttgtcatatagtaaagaatttatgaaaattgcaacaaaataatttgaaattacacgatcaaacaagctataaaactaaagtaagcttttatgcaaattggggattggaaaaactgaagaaagaatggggatgcagagagaatggggattccttttatgtaaatcacgtctctgcatgacgtgtttaatcacgtccatgcaggacgtgtcttgtgcaaagtcacgcccacacaggacgtgtttgtgtgcttaatcgcgccatcccacgacgtgtttgaacacgtccaagctggacgtgattcaacacgtcttacccagacgtgtttggcagcagtagattcggaaatatgtttcaaatgaccatattttggtaattttttatttaaaaggcattattttaatttttttgcctccacaatgggagttgtttaataggttacttataaaaaaatattattttgatatgtcacatatttgattttgtgttgtttatataagtaactattactcataagttgcttaaatttgtattaaatacaggagagagaaagagaatatttgagttaaacaacatgtatgttaattaagtttattaatttttttaataataactaccttaaaagtcatagtagtaatgagttttattggttgataacataattttttttcactgattgtgcctagttattaaacttatatatatagcttatgagctaatcttaccaaacaaatccatcagtcaaggaatgttccactatgcataataaggtgaagagtattttttttccaatttagatgacttctgtatgatggagagagtactttaaggaggtggagtaaggtgtggtttgcactaatttgggtaatttggttgggccgaaattcttgtacattcctagaagacacaaaagaggtggaggaaaaggtagaaatcataaaatattattcttgggaatggagtaggtttatgaaagtgtttaactattctttgttcagatggattgtaaatcccaaggcttgccttggtgtcctttagttgagacggggatcaatacaattgactactggagagagggtaaggaggtagaaaacagtggtggaagttagaaataaggtatgtggagaaggtgatacaaggtggttaacaggaataagatagcgaacttttttagtattgaagtgatacagtgcagggtagaatgaaagtggtacgcgtgactgtttaagacagacaaggccaaaaatggtgtgggtataatgtttgctgcagctcaatgcatgagatcataaggcaccaatattgtacgaggatgtttgcaatggacatacacgatatgaacatctcatgattatcacacatatactattctggtctcaaatataaaaataaaataaaattattcacactaatttaaaaaaagttaattaattatatttaattacatcaatcttaattaattaatatttttaacttattcttaattgaaactaaaacctcaattaaataaaagatattttaaaaataatatcattaaatgaaataaaattaattaaatttttttatatttaaaaccaagaaaaatatgtattttttcttatatttatgataaaagaaatacattatatcctattgaagcaaaccgttgttcactttgtttgggtggcaagctgttttttgggacttgcgtagaatacatggtgggctgtgggcacgtggttagaacttagaaagaagatacgtaacgggtgacgaatgtatgagagattaaatcaagagaaaaatgatatgtttagatgtaagtttttttagaagtatttttaaaataaaaaattaaaaaaataaaatgaatttctccataaatttaaatgagttttttaacttatttgtagatatcatctcatcttttagaaaaattatattagtgaatttttaaaaattagttaatgaagaatttatatttatttataaaaaaatttatctcttttttttttcttcttttaaaaatgtttctaaaaaagtttactcaaacacgccaaaaacaaataatggtattttatcacacgtgtttggttgtttccaggggtggagtgtaaggaagcttaaaatgtcatttacatctttttttgttgttgtaggggttctacataagccttggattagaggtactgtattgggggttaactgtgtgctgttttggattttcagatcttaacactacttgtgttaggtctgtttacatgctttataaatgtatattttttcttttaaaaaaaacaaaaatcttaccaaacacttttttatcacgaaatttgaatgaaataaatattttctttaggtggaatgaggaaacgcaaattgtatgccaattgaggaaaggcccacatcaaaccatggcaatagcatatgcactacaatgggataagggacaacgattaacatgattagacgaagagttcatattaaataactgtatttgaacacatttagcgatgcaatgcatttacctgaataaggagtatctgcacagagctcccgaagagtagtcgttgaagtcaaagagagttttggacaattgtggacaatgcgatgctttacagtcagcaattcagtcccttggtgaagggttgagagttgcataaatattaaaagtttcagttttggaagctcaactttggccttttctatctcaccaccttttcctcgtttaaatccaataagttcttctagttcagtcgctccatctatgatcagaagctctaggttgggaaggtcattagatgcagatgcagagaataaatgtttcaacttgtggcattgttcaacaaccaccacttctagttttgggaaacatggttctagagaaacaagatttaacatttttttatcttcttcgatgatctgctttaattctttgcattgtcttatctctagacgcttcaactctgataggcatcttaaaacacacagaggaaatattacttccaatcttgcacatctcgttatatttaatgttccaagatttcggaagctaaaagaattcctggaatatccttgttcaaatccaataatctcctctagttcagtggctccatctatgataataacctccaggttgagaagatcactagatgaagacgcagagaagaaacgtttcaacttgtggcattctttgacaaccaaatctactagttttgggaagcatggctgtgtagaatgatcagacaattttttatcagtcacgtcctcttcgatgatctgctttaattctgtgcattctcttatctctagatgcttcagttttggtaggcatcttaaaacacacgatggaaagattacttccaattttgcacattcctctatgtctaatgttttaagatattggaggaaaagtgaattcttggaagccacccaaatatatgtcatttgaggtaggtcgcacaactccaacttttttaacttcaatcgcacttgttgtccaatctgaatgttttttcgctgaagatgttcaaaattattatgagtctctttatttaatttcgcctggcatccaacaaaagagacagataatatatgttgtaaatcacacccttcgatggatagccgtttcaaacctaagaacattgaaatatcactctgaaattcacgatcatcctcaacgacgttttccttttgatttttatgacctctttcacgagttaggatatgcttcaaaccatcacaatcttctataattaattcttccaatgaagtcaaggttttagccgtggatgccgtaaacaatgagcccaatttcggacatgatattagctcaagggttgtaaggctggatagagtaaacgatcctgaaaaagcagttactcataagcaaaacattgccatgcatattagaatcaattatataaatgttatgtcgtcaagttacactttgatttttaaaacgtttttttttttttggactaaaacaataaacacaagcatcaaattaagttaataatgaagaataaaatcattctaggacaatattcttatgctgattcatattatgactgaccttatcttctaataattttatatggaactaaaatgttaaaaaatgaaaatgtaaatcttctttgaccatttgataaataatgtatgcaatgttctgacaattagattgcttaaaattttcatatatgataatagattcacaatttaaatgtgatttgtaattgtacatgtcaataacttcaaacccaaacacataccttataaattttaactaaataattatataaaattataagtgtaatataagaaacacacttattgacttaagttcaacaatttagttcttaagggaggaatagagctattattcatttgctaaaattttacggaaaccccacttgataaaattaaattataatgattattggcaatatttaagaaaaattatctgcctttaatcattgcttagatcaataatcacttataatgattgagatttaaaaggaaaaaacttggaatgattgcaataaatcatatcaacagttcatgtaaaaagaaatgcacatatcaacagttcaacatactgttatgagtttttttacgatgtcacaattgaattcatgttgaatgctttgttttgtctaaccacaatttttgttgaatatgcagcccattacaacacatgtatatttgctaaaagcctataactgaaaacatgcttatgaaatgcaatatggaatgtgtacctgagctatggttcataagaggtcctagtggaattgaagtgctttctgggaaaatttccaattgattagcttcaaaatgaggattcaaaaactgttgatgttgctcatattgaatgattttatctaattcttgtttttgatcctggtgtgcaagtggataattcggataattcgtaacaggtggtgatgggacaatatcctcaactagttgatctagttgattgcaatcttttatcttcaacactttcagttgaggtaggcctcgaacagtattggctgagaagacatactttaattctctacatccacttactatcacttcttgaagattctggaagattgtggattgaacatgactttgagcaatagcatgcgtgaagaaagatgtcaactgtggacaattacttaaatacagcttctctaatttctcaagagggccagtaggaggtatacaaccgtgccataaaacttttaattgatccatcttgtatattttcagcttaagcaacttggagaagagaattcccacctcactcaaatgattgctagtgtcaaccaaacactctatctccttagaattacatatctcgagcttcttcaactcatgaatatctcctttttccaattgaaatataccagggattatattttttgcacctccctgagtatttgctatgaatataacctttgctgtttttgccaaatcgttaatcgccttatttgatatgtgaaaacagctaagcattagagttcttttaggggagataaaatttgcatcatcatcatcatcatcatcatcatcatcatggcattggcttcctaattttattgtataccattgcagttcttgggggacactaaaggtgttaaagtatttaatggtgttttcattgtaaacattccattcttgctgtctattaatgatgctcaattcttctagccgtgggattctcctgaccacatcaaaattattcgtctccatgtcacatttatataacattaacgatttcaagttggttagttgtgcaactacaccatcattttgtaattcaaggaatgaaggcaaataacaatcagacaatgcaaggcactcaagtttcttcatatcacttataaatgagatgtcacttaattcccaattgctaaggattagacaacgaagttttttcaatgttttaaatgtcattgttgacaatggtagtttgtgcccccctccattttcaagatacataactctgagattttccattcttctgaaaatttcatctgatatttccaattttgtttctatgcaaagaaactcaagattggaacagtccaaatcatttggaaatttcacacaccatagatatcttactgaattttgctccaaagttacatccttctccaattcgcacttaatgagcttatcctcattctttgctatcaagtgggctacatcgcgatgaaagtcgtgcattttgacacatccatgatatgcatgcaacaataaacaagaactcaagagcttaattgtggctgcaatcacttcactctttgcctcttcatatgagcgaacttccccaactacacctaaccctattgcgcatcttgttaaaatttcagttggaagttcataatcttcagggaatacagaacacaacaagaaaagtgttttggcttcttcactatccaaattatcgtagctcaattgcaagcatttgtagggatcttgcaaacctttttcaatattcatcggcttagatctttttaatctacccaatgcaaccctccattccacttcagccttgcctttcaaagtgctagcaacagctgcaatggcaacaggcagccctttacattcatttgaaattaatcttgccaaatgctttacagtatcaggggtgccttctgttataagtgctttctcctggaaaagagcccacgcttcttcactagttaagattggcaagtgaatctttctttggcaatccattgaagtacaaactgcttctgatctagtggtaatgagaaccttcaaacctttatggtgttcaaaaaagggaatccctatggcaccaaaatcaagcttctcccacacatcatccaaaatcattagaagcttattttcttcggttaatctcatgaataagcgttgggctctctccctttctcccgtttcattttctggaaacccataccccaatgaactagcaatttttgcttggatccttcgaacctctactgtactagacacaggcacaaaaagcactttgtcaaaaagaccctctgcttttgctatcttttcaactttcattcctaacgtggttttaccacaacccgccatcccatacaatccaatcatgacaacctcattatctttcagtgcttccattagtttctcgtaagcagattctctactgtcaaaatccatacatttttccgagagaatatcaagtgtgctagaaggaagtgtagtagtgcgttcaatttgaatatatggtccacctttttgaacgagcttttcaaggtccctagttttatttgctaacttctttcctacacagtatcgccaaatccaattcggagagtgcccaaaacaacaacttttttttgttcttgcctctttcagcaactgattcacattgtctacgtcattctcagcatcctgcagccactggttaacaacttcagcaggcgttctcgtttgtttcttggcatgtgcaacaaatttttggacatcatttttcgttacaatcaaattgcgctcttctttctcaagctcttcaatcaaactgttaaaacaacaaggataacgtaattgatttattgctccacacactaaatctcttgaaatagaagatgcaaaaccgtaaaggcattccatcaatttgctccactaaatgcaactttctttaacctgaacaaaaaagatgaacatcctacgtagtaagtttataattaattataaaaataaattatgtatatacatattgaacatatacttattagataaaaatgattttaagataatttattttgtttacaactttatctaaaaatcacttttatagtacaaaaaagaagttatggagttagttgtagtgattagttttaatgttttatatttaaaagatttaaatattttggagatccttgaaatatacttgaattttgtaaatgattcctgaaaaaaaattacttctcattgagtccctaaaacttcaaaagttttgtggaagatacatatcgttagtctccgtctaaaacgtgatgacgtgtccgttagttggacacgtcagcgatacacataagaattggtcaagtcagacctccaaacgaatgaactgttgacatccaaacgcgtgaactacaccatctcctcctccttcgccaccctcttcgccaccgtcaatggcttcctcacctccccctccttccatgactccaccggcaccgtcctcccctcctccctcccaacctactcccccctcctcggctagttccccgctcgtttctagcaatggctttaccattgcatgagatcctagtccttcaatgaaatttattagtataatttcttataccgtatgggtatctgactgagccgaatgctcataaatatccctagtaatatttttaggacattaaagcatatctcttctaaagtactcaagtatttggttaggtcgaatactcttatcaccttttcacccaaggtgatctctctgcataagtactcaggtgttcgattaggccgaatacccgagtactctaaatcaccttgtcacccaaggtgatctctctacataagtattcaagtgttcggctaggcaaaatacgctaatctccttgtcacccaaggtgatctctctacataagtacttaggtggtcgactatgtcgaactcctgagtactctcatcatcttgtcacccatgataatctctctacataagtaccctggtgtttggcttagccaaacacccgattactctcgttacaatgttgtctgaaaggggtccctgtatgtagtcaagtactcagacctagtcgaacacctaagctcccttgttacttatttggaaataaaatgtctagtttattctaaataatagtaattaaggattaatttaatcccttaatgatgattagaggaacattacctataaaggtaaccatgtgtaagagtccatggatcgacctactaagttatgtataaataattacgtgaatatcaagataaggacattattcattttcatttaatacacttgtttattgctctcaatcgagaccttacttaagggttggagtatcttttgttgatatcccacccttcgaattattgattattatattgtgaaagaaagagattctcaagaagaagacatagggaagaaagttacctatttcatgcaggtacatttctattataattttttaaaaggaactaattaaaaaaaaaaaacaaattattgcaaagactaaaacaaataaaactgatgtattagtggggggaaaaataacacaaaataaggaccaaatccaagaaaagaaattttcaaggatgaaaagtaaaaataaaaataaaaattagagactaaaagtaaaaaaaaaaaaaaaagttatatcttaaagataaaaacatatttaagtcaaaataataataataaaaaatacgcatgttttatattttttgcattggcaggattcaaagatgagtctttccataggctctgaataagttgttcttataagctatttaaaaacattttataaacctgtcataagatgttaacataagataagttcaaataagcttttaaatgggcctaaatctaaccagagcaataacatggatttcattaaaaataggaattaaataaaaaagttatacagaacaaaatcaaaattagcttatttatcaaagataaaaatatacttaagctaattattatactaaaagagcaagtcttggtcatttttttatatatacctttctctaatttgattttatcttttcgaaaaaaccagttatagtattgctaaaacaaatattggttctctcaattttattttatttgtatttataagaatcaatagatattagaaaagtctgctcttatttttaaaatcagacgagtcaatttgactgagaatcgagttagtatctaattagttaattataaaagatggatcattgcgaaacttgtgagaaccaataaatatccggttaaatagatccaaaactagtaaaaatcaataaaaaaaatcatgtaaaaatagggttgaacctatatttttatgtttattttacatttgactaaaacaattttaagataaatggaaacatatatttaaaaaacacagcaaatataaattgtttcactaattattaatattttatttataaaacatataattcagtcatttatattagtttatcatttttataattttatattatattaatttatcattttcttttttattttatatgaaacttatcattattaatggacacatattttattaaaacttaaactaagtattatgtatagaaaattcatatccacttgttcttgtttttattttatctataggtaccaaagaattagcagatttagtagccctggggggaaggagcattgatttggattttggactgaacatgtcatccatgcaaataggaaatgagcaaaaatacgtaagcttacctctcctcttacagaagattcaaggaattgagttatatgcagagattggtgagaaacaagtgtagatcgatgactttacaagcaagagacggtgaaattaatctaggacagttgcgttacgccacaaacatatatatgatctgcagactcccaaaggaaattattatattagaatacagaaaccgcaaaaattgcaaattaaacaacttgctgccatatttttaatatatacaccaccttcagagatgaattccattgctcgaatctccaaagaaacaagagaataagagaatcctcactcacgctccactgctgcaaagacgattgctagcactactattcccacacgatcaactaatcattcattttaaaaaagccaagtcttgggtcttttgtcttattcatgctataaaagctttagtcttggtcttttttttttttttcacgagttattattatctacttttattattgttatctagtcgtcattgtcaatgactcattcacttgtcctgattgctcccttagttttgggggcaataacgagtaattaacaacataacaggttaaaatcagaagtgcccaataaatttcatgttgtactcactttttctaagcgtattattttgttgatttttattttaatgttctccttatatacgtgtttggtttaggagaaaaaaaaagtgtatctaatttatttttacgaacacccttccttttttaaaagatgtagtaatagaagcctaaatttcatgttgtagtaagttaaccatcgaacgtcattctctactttattcattcaaagagcatcattttgttccaaggaaggtgataatgaactcaaaataggaacttggaatcttaagaggataccgtgatcaccaaatacattgcaaatcacagagaaaggggatggaatttgctagtcatatactcaggtaatctaagaaagtactagaatctcacactactaaagagttatacaagggactctcaactccctccctccctagattagtagattatatattattatgatcaatttacctccttctgatcaattaaagcattgtaagttacaacttacaacactaaaatccgcagttgcattttgaaattttatcacatcttaaatgtttttttttttcatttttcaaatttaattttcagattgtcaaatttaactacctgtataaataaattattaaaataaaatttaacagagacaaatggagagtatacttagaataacaaggagtacaaaaagaaactccctaattgttttatgttgcaaagtttaattatacaaaagattataagttaagtccaatattgaagactctttcttttcttgttcttatccatataactaagttctgagttgtgacgcactgaggaggacacactcaacctttcgactttatcttccatacttttaagatattcttgttcttctaccagactctattaattttgtatacataatagcggtgcaaagccaaatataatttgatcatcatcattttttatttattgaacggttgaaatcaaatttataacatattcttcattttttatttatttttttaaaaaaaatccagccttcttagtttttataaacctcgctttttgttttttaaatattcgttttaaacacgaggaaaattgctaatcatttgtaaatgatatgtttagaatgtgatggaattcaagattcatttcatagttttctaactcctgacgtttctttttagatttttaaaaattataattttcttaagaaaataaataacgaaaactaattattatttttgttgaaaaatgttattccaaataagtattaaaagaatgcaaatactgggccttatttctatttcactcagttgcttcattgactcctattagctatttgcaccttgactaatgcaatttcggaacctttcgcttcgagtatttttttccgggacataatacaataggtgtttcaagctctatgtggaaaaagaaacgtagaaaaccaagctacgtgaaaatattgcagcatacaataccagaaacaaaacactcatcatgaatagcacagtagttgcacaagactttcatttcagtaaacaattaataacatagtagcctccgaaagatgataaatttggtcctttaaaaaagcaataaacaatgaaaatcctgaagactcgagggatttctagcagcgatgggattgtgctcaaattggctacacagagcccaccatttataagcgaaataattcttaccgaactttgctttgatcttccaccatttttctcacattttcaagctcctttttgtaccctatagtttctgcaatgcatttcttcttttactctctcagagatgataaggcggcctcacagtctttcatttcttccttcaatctaatgaaccgttccttcaaaacttgttccttctgttgagcttcatccatgaatgtccctgcctcggatatttttgaaacgagtaatggctacctcgtcctcattccaatgagcttcaagcactgccaacttgtcagtggtagcaaagccttgcttgaaggaacatagaatgcttgggaactctctgtgcctggtgtctataatatcttcaagtccatctgatagagttgcatctttgaaaggaaggttggacaagaaattaagtcttttgccataattttgtgagatcctccattttgtgacactaaagagcgtccacaaacattgcaaataaaaggcagtttggaattgcttaaaaagttcctctgcttctattttttacaagcagagaggtcacagacaatggtaatctccaagtttaactaaagcaaggtatcttaattacttcccgtaagatcccaatatatttggtgcgatggatgctatttcacaccggttttgcttactttgtgttataaggtgttatatcaatattacttccagttctttttcttgcattgtagataatctcttagtactctctttacttattttcagttttacacgatgctcttattcttgttttaagagttttgtccctgatgaatttggtttttatacaaatcttcctttttgttttttacaaagcaaggactgtataatgtatactttatctgtatactaatattgaaaaaggaattaggcatccccctccctctttggctttttataaagtgaaaagcctaactatatcactttttgtttctcaatcaaactacaaattgtacataaaaatccgggagctacaaagtgatttcacatcagaagacaagaagagaacaaccaagttatggttgatggtaaactaatctaacaataatatacacgagaattaaaattacactagagcaatacagtttttaacacattgacacatacatttagacatttaacactagaaaactggtacaaccataaagatggtttcaatttctgaatggttagcagcaagccagcaacactggtctttgagttgcaggtttttcacaaactctttctggtgccatcgtaacttgtgtcttgctattgagactccaattattcaaaactctagcataagttgaatccatttttagagttatctaatatgatatatatattccaacagtttgaaaatctcatgacttctttgtgttagttcctctgctgatgattagctggaattggaaattgccttggggttctgctgatgtcacgtgcaatctcaatgcaagcttgatcaaccaatccccagaaattcttgactatgacaaatagttgactattgttttctgcaatctcttttgaagctccaccttgataatattgtgttactttactaagagtaatgagactgaattacgcaaactatattcccctactctctgttcatctgaagcaacattgttctcggactatccaacatatataagctaagaatgacaatcttgtatcaaatagaaatttacaaaagccagtgactatatattatgacattaacaaatgatcatcaatgcatgcatgactcagttttagtcttttagaagcaaaatcttgattctcgagtattcacgtgaactcttgtgctttatatctggcatgaaaataatctgtaacacatataacatcaataaccattaagtcactgtcatgcttctaaaataaatcaaattgccaaaataaaatatgccagtagttttgttagcacagacttatgctaataaactcatgcatggttgcagcttttaccttaaaaagtaacattgctgcagcctgcaggcatcctatggtttgattgatgaacatagtgtatatatcatgtaatactcttatcccttgaactcacgtaaacaatatatgcctcgggtttgatcatctgagtgatagaatgatacatctgagtttgtaagctgattgattaatgtatcctataagctaacacaatgacagaatgatacatctgagtttatattgaccattgaccgcagtcattgccaaatttgaacattgtcatatcagcatgtaaggtggtaggtccattttgattgtagggtctagtatagctcctctgaaacttttgaacattgtcatgtccatgtccatcctgtgaccccattaccgttgaaatagttggcactaactagaatacatactttcatatccattctactggcactagttagaacaaacacgtgtaacttcatcaaatgaatggatttcacgcccattttaggcacgtatgagtatgactgtacgaccaaatggactgcttgctggcactgccatagtttcaatagcaagaaagtgcccctcccacagcagttctgacaagttatgtcaagccaatcacgaggttgacaaattgaaaagtttgttatctaacatgtagatgtagcattataagtgtagtttcaataagagtaaacactagctttggtagtcatcactcaaaaaggttatcaacgttttagtactaagctcaacaatttgttttggaacccgttagtattcggttcggaaaaggaggatcagtgacatcaaattaacaattttctgcatacttgctcacttgcatacaatacaatacaataatcctcttaattcttcttttctctctttaaagttgttggatttaaaattgatttcagcctttaattgaatgaattctttaccaaccagtaaaaactggtcggaaatagagttacaagcaggcaatctgtcctgacctctctcacaagagttacagagaagaaactttaccaaacaagcaatcactagatcttaaagtctaccagacaaatgttacaaaataaaatttcaccttctaaaacatccgttgttaatatctcattggtctctaaccaagagagacatagtgtacagttaaatctaaaatactctgggaagaatgctaaagcacaacccaaataattgttttcactattgcataacctacaaagcatttggttctgtagcagcatgaagaagctcatctggagttgcagccggatcaaggtcccaacacctttcaggcaaattgctagcctcccccttcagcaaccaagaaggcacttgatgtgaaaagcgcaacatctctcttctgggtatccattttatggcactcttgtctgtattactctgatatactgttttaaatccagctaacttaataagaggactaacacaaacaccaagttcctccgagtaatcatccagcacctcaaccatttcatactgatgcctcacttcatctggagtagatctgttccaatccgacgaccaatttcgatacacagcccaaatatctccacttctaggatatattcggacgcaaccacctcgagcagccttctccttacttagaacatgagaaaatatgttaacttgatcaacagcatctgaattaaaagccctgaaatttccacaagatttggtaaaacctgaatcaagccagtttactgagccaaactcactatcagttttggaactcaagtaactgatgtgaatcttaaatggattgacagacacaacctcacggatcatacaatacaaccgtggcattccatcttcctcatcatacaaggcccatatttgctttggcctgaagcattcctctgacctatctttgtcaaagtcatgaaagtcagaatctgggacagtaattgacattggaccagttttcccattctctaactgtagaccagaaacattcagagctgcttttctacatgtctctcttcttacttgaccaacttcagcttgtgatttttctctctcattcagagctgcagctactgctgctgctgttgcttcagatgacaacttcatctcctccagtttcttcctgatttctttcctggctttctcaatcaacaattttctcgcgtcaaaggccggtgccatgtaacattgtttggtttgaacttcaactgtgcaggaaggcttttggcattgtcccatgctatcatttccgttagccactatcaactctgaagcacgttttgaacccttttcttcatagccatttctgaaactggctcccacaacaactttctgtttcttgtcaggtctaattagtttatcttcctgtggttcactacaggagaatattatgtctgaatttgtattgaccatagtctctaccatgtgatgtctcttatcagctcctgacttgacttttggtcttcccctcttcacatttccattggcctgatgaacagaatcagcaggtaaggtagctgatccattttggttgacaactccagcagagccccactgaaatgaaacattggggacgtactcatatccatgtccagaatggtatcctgtgaccccattcccattgaaatagggggcactagttggaacatatgtaactccatcaaatgaatgacttccatacccatttcctgctacatatgaccaaggacaatatggaaacgaaccatttgctggggccgccccagtttcaacagcaacaaaagtgccacgacagttcttacaagagagtcttttattcacatacttgcgcagatactcatactgaaccttacaagaggtgcagattgtccaaaaggtgtcaagcccaccacgaggggttgacaaattggaatatttgttataacctgcggcccctttagcatgggcaggagacaaattcgtctggttagtcccacccaactgcacatttctcttgagatcataagaactgcgcatagcactatctgatagccaagtccaagcctcagaaacaagcttaaatgcctcatcagctcccacacatttgttcttatctgggtgaagcaacaccgccaacttcttgtactgtttttttacagcctccttatctgcaaaaggttttaatccaagaatcgaatagtaatctagctcaccattatgtttgacctcagaagcaatgtaaacttcaaatgtggccaccatttgagatataccctccaatcctggacagagagttttagcctttacagcatagtttttagcaccggcaaagtctctcagagcaaagcgcttttcagcaatctctatcgctttaagtgcttcctccttgtttgcttccatgtaggaacaaaagatcacttcacaactgaactcttgaaacagaaactacgaccagcccaacatcttttccaatatcatacataacctcgtttccatctctgcaaaagttttgaaacaaaaaaaaaccaagtaagtaattttaattttaaaactcacaaaactttcatctgagatccaaaaacaccaactcaaacattttcacaaaattaaacagacatttgccaacatcaatctagaacttatgctccctattgttaccgagaaaccaagaaccctccatctcaaatacgccaaaaatgtggaataaaacgaacagatcgtggcatttagttgattgaaacacaatttttgaattttccacataaagcattaaactttactttccagtctatttcctaaatcttccaatttcaaaatcaataaaacattaatcaacgggtagaggtgacccatctttcaatcagcacccaattcacccaaatttgacaaaacctaaaacttttgcgcatagatcgaaagtcttaagactaaaacccccaaaatttatactcataatttaaattaattcggaaaaaaaaaggcagatgcaataaaaataatcacaacaattaaaaaaaaaaaaaaaactaactgagattggagacgataatggggtgttgaagaagagccagatcgacacgtgtagttacgagatgaagcaaaattgtgtgtgaatctcgcttcgctaaaaacaggaaaacacagaacccgatttgtatggacacagtggtgtgtggtaaatggtaaaggtgaagcctttgctatggaaaaacaaaaactgtgaagaaaggattcgggtggctctcggatccgaagtgggtccgattcggcgcaaggtggcggcgatgaataggagcttccgacaatcgccgatcagaaagagaagagaccaaaataaaaataggaattattataaataaaatgatgataattttcagagcaagtaaacgctgttattactgaggtggttggaacaagctaacgtgcaccgtaggtgcgtaatgactaaagactgcatagcaaatttattattatttattatttctttttaagaaaaaaagaaaaaaagaaaactactaatactttcttttgttttatgtttcgcattttttttattgcatcttaaatttagtttaaacttatatattttgcggaagttggaagttagagactgtgttctgtagttggtgtgaggttggatgatgatttggagaattatcagtgatgggcattgggcacttgtgaatgctccacattgattattttatattttatttttaaaaacaacaaaattatttaatattttcccatcttataaaaaaagagaattaatataagatattataaaactatttaaaataacccactagtctaatgatgcaagatttaatataacatttttatttttgacagttaataaagataatttaatcaattcaatcttataaataaaaatgaagagagtattaaattcaaatttgattggtattattgtagacattttaattggttagcattaaatacgtatttatggagtcataaatgactgtataaatgtaataattggaattgggtgtataatctatctacttttattttagtaatctaaacttcctttttttgtgtgtgcttgacttactactttcttacacacaaaaaagaaagactttatttcttcttcttttttggatgcaacatttttaaccattttatttcacttgggtttacaatttttaaccagtttggtgcgattgaacttgcaattttttaggttgagttctacttaaacttctgagttctgacatcgatttcaagttgtcaatgtcaaataatttggacttaaccagcaaaaatatggggtctctgaaatatttatttgggctaacggggaaggcccaatgacattcgtctctgaaagtaacaaccaaattaatgtaatgtggtgaccaaaaaaatattaatgtaatgaaggaccaaaacaatattaatgtatcggttgaaacttgaaatgaaatgatgttgagtacagaatcaaacggacaacagttgaatcttgaaaaatctggttctgccaaaaattgaagtggttggattggatgcatactttgagtcaatgatcacagtaacatgtttgtttgtccactgggttgattgtgtttgctctgtctcaatcaataagaaggacacttgttttttttctttttcgtattcttcaacactactcatactgtaaaataatcttttacggaggtgaattaaattaatcaacgaaggagatggaagttttgattttgacatttgaaaattttgtgctaccccgccatttcaaaaatagactattcagcaaagaatttttcaccttgatttgcccgtcttattgaatatgattatctagtaaaaatttgacgtgatatcatattttttccatgattgatatcattaaaatattacactttatgcccgctttgtatccgttttagagtattgtattgtagaatttgctaattacaaatattctcaacagttcaataagtttatatatttgaatgtctcatcagtaaaaaaaaatagtatcatctttgttttttgttttgtttttttttaagatggtatcatctttgtttttacttatatcaaaaactgaattttttctatgattgtctcaaaattatatgcttattaacttactcaaaattaaagcttagtctttgatagtttccgtgaaagttaagaagattcgctagccatgggctttagtgcacttaggtttgtttttctatttaaaaaacttggctatagaataagcttttaaatatgcctttaaattaggttgaacttttataaaagttgtacaaaaacttaaaagactaatatcaaagtaaataaatcatgttctttatttgaaaatacatttggtatatatgactggtagattcgaagacaaaaattgaagtttttatagtgacatataaattaggtgtatttctagctaactttatatatatttgtatctattcagtaaaaaaaatatttgtatctattttaatgtcagtttagttttaacaattataaatttataataatagatcatatcagtaaatatttaataatttgataaattttttggaacaaatttttacaataatacacgagtgagagaaattaaaaagaagaaaaacatatatagaaggaatggtgtaataaaaagagataaaataaaaaaagtgaaagtgtacgtaaaattatggtaaaattttgttatagaaataacattactcttttgagagaagagagggggggggggggggaacacattgttactgaaaaagttaaaaagtgaattatctctgggcctttggagtgtacgaataacactttttttttttgtgaattacgaataacacttctaaactgggctatagctcccaattactgtaataaattataaatagttaatagaatatcaacggtacttcccaatttaaggaagcaaggagggcaactaaaaaaaagaaaaaaggaaaaggttactggcaaaatcaaattaaagaaaaataaataattttaaatcctcaaacttcattcttctacaaatttatctactatcttttgtggtaagtttttatatttttaagatattaaatattttatttttattcaatacttactataaaaactagtaagatgatgaagttggatgatataaaacattactcaagaaaaaaatggaggacgatgataggaagtaataaagcaaagtttaaaatagagtactagttcaactaattaaaccttggttaacaaaatcaattgattgtcaaatgaactacctagcttcatatacacaaataaaagataaagacccattcatcactgatccacgcttatcacaactttttattgatatgtgcattaagatataagattgatatagtgatggaagaagaagataaaaaatagttaacaactttaaatttatgagtaataacaactaataatactaatcattaatatttgctgataaaaaattctattataatataatataacaaaaatatgaggaaattaagagatgagaataaacaaacaaattggtgatattttaatttggtatatggtagacaaatcaataccggggcagtacgtgcttcttatttcctgggcaaggcagggaccaagatttgattattattttttttttttttttggtaagatatcaaaggaataatgagaaatggtggaaaaatgagagatgatgagatcagacgttgacagtgttgcagaggaacatgagggacgatgcggacgcgtcgctggggatccttccactcccgagcctctcgtagctgtcaatgcaaaacaaggagagcgagagctgcacctcgtgccgagtccacactcgcttcctcacccgctccgagtttccgagtcgactcagcaccggtctcacgcacaccatgtacagccgcttgtacccgcccagcgctaccaccaccgccctcaccgacgccggcggcggtgaggatacgtggcggaagcacaggtgctcccacagcgagtcgtcgttgcgcgtgaggctgcaccacagtcgacacacgcacgccgccacgcccagcgagggaccgtcgaggcgtttaaggatttcccggagaatgtcaatgttgtcgtttatgaagaaccgatgtcgtttctcttgctctccgcggtgctgctgctgcaccatagttgcggacatgcacgatattattcacagagagaggaaaagagaaagagaagatttatctagctagctagtggaagtggaatggttggtttaagaagaaagtgtggcatgtgaaagatggagcagcataaatgtggggtaacaatattaggtttcttgcagtgaaactgtatttggattctctagataaagtcccaagttttaatatataataaatataattatatagggaaaattttattaagagatcaaatttcattaaaaataattaaatatatttttaacaaaagattaattatcgacaaaaaaaattacaaaatgtttttggagaaaaatattcatgaataccctattatatatctaatgtgagaaaaagaaaaagaaattaaatattataaggattatgatgtaatatgaaaaagagaaacaaagaaaaattataaatattaactaaatgtttaaaaagtgagcataagtgtgtgggggagggtgggttttaagtgtgagaagagaagtatattttgactttttggggaaagaattaatgaataataaacgtgaacttgtgaagggagagaccgtttacatttgttactacgttggattgttgtttgttgttgtggttggacttgttgttgtgcatgtagagagagaaggttaattgtgagtatcgaggggagagaaggggccaaaaggaagttccaaattaaccaaagaactggaaccaatgcggtgcttttttcctcttgttgcttttctatataggtttcggggtgagcagatttggtgtttgttgtttttgttgttgtttgcattcttttccaataccttgtatcaattgaggaccgttgcggatcagagagagaagaaattgagttcgctaactttgaatttttctatatatgcttcgtcgtgctgttgcatgattaattgtcacccagtctatgcagacgttttgtgtttttttttctggacgagactttggaccatatattttttttcatttttcaaaataaagtagtataaagaggttaaattcaagtatactcaagtgtgaatttgaggcttcctacctttctatggggccatgccatgcctgtttcatcaccaaaaattgatctatcagttcagcctacaagtctaaaaattgggaaacctataaaccagaagcctcccacttgaataagtatgttggcatatcttattattgagtgtgttccatttcatagtagaaagcattgatcttgaattccgttaaacttaatttagtaaaaatataaatgtttgaatatattgttggataaaactatttttactttgattaaaatcctggtttgactaagaatgtgtttggttacacattatgcatgcatatctaatgaaattgtgtcatatacaaataaatgaaatgacgcgtatcctatgtttggttaggcgttgcaaccacatcaaatgaaaaatttagcattctgagacaaaaaagccaaagtaatacctaaattgcttctgcattgcgttatatccaatgttatcacagatacacacttaaaaaattataatttatagttattagaaagtcttaaacaatgtagttataattatgaatgcatgttatctaataaaattatttcaaatataaataaacgaggtagaagtaataatttgtaatttccttctaggtgtggaacttcacgtgcactaaaagtgataggaaatagtttttgttttgagttgaaaaatttatattaatttttacagcaaatttgtttttagtttaaaagaatctaaatataaattatttttacttgaaaatcaattttaattaaaatttattttacaaacactcatctaaacataaaatattattagtcaaaaatatattcttagctagacgtagtgttatgttatgtatgatttttaaattaagtaattaataaatttattatatatgacaaattattataaaataattataaaatcattttatattattaatttatcgactattttacctttatattattgtactatctttcatttaatatattatgtggtaaaaaatgttaaattatatttattcttctttattagttgaaaatataataaaaaataatatacaaatatcattaatatgttgactattatttgcatatatataccactgcaaagttggatatatatatatatatatatatatatatatatatatatatatacacatacatatacacgtgaatagctggcatatatatatatatatatatacacatacatatacacgtgaatagctggcaagtgcgctgataaggttgaaaactctacattcatgcgatgcatgactagtaactaggtacaatatctagcaagagttgacctccatgtcaatgatcagacctcgatctatataattttgtaacattgtttccctttcctacgctccaagcaaaactttggattccaacagttttcaagatttgcttaaattatctttttaatttgacttataccttggactgattctaccaaatgtttcatttaattataaaaacaaagatacaactgatgcactgatgtaattttaaaatataaatatagtatgttctgtttttttttaatgaatcagatatcccttttccgaatctcaaggatcaaaatacttaaatctggaattaatttctttcaatatatttttttaacttaaatacatttttttatgcaatttaatcatttttttagttatatacttataattttttcaatttaatctttacaaaatatatttattttattttttcattcttaaaatgttttaaataacattttgaataataaaataaaaaattacaaaaataaaataaatactaaattttaggaaaaaatatatttatatttatattttttcatattcacatgttaagaatcaaacgcaagactatacatatttaaaggacaaaattattcattaatcatatcacatacagatgttggttggtctgctatgttcttatttcttgctaatgtttaattctcatgatatagaattaaaatgaattattttcttaatagctatgccataatttcctttctttttttattaaacttattataaaattcaaatcttaatgaatatgtaacgcaaaatgaggatatctttgtatttggcaagatgaactgcgttacttaattaattatttgatagaatatacattttaataatgatcattgacttgaacaactataatggtgatcgatgcaaataatataataatttgcttggatcaggaaattaagaaagatactctattaattaacttgaagacaataagatgaacttgtatttcccgttccaatcgagttggcatttgaacaccaaaacagtgcaattcagaaacagaaagagaacgcactggagcaagcagaagcagaaagaaatttttgctggtgaatggttagaataaataaatggaaaggaaaggaggatggatcatgttccaccaaagaagtgcctaaagtaatttccttccattgtgaggcacacgaatagaaaagtcacgctacagtaattttatgtttttgcacttgatgtggaatttgaatagcaacaaagaaagaaagcaagaaagaaaaaaggttttcagatgacatggtgaggcaatgtctcacggggttggattttctcccacaaagaaaagcaaaagccccaagtcctttgagacagaaagcataaaatataatttcatttagttagggtagggggggcttgaaattgacatttgatttattaattaggcttctgtggagagagactggaccccactcactcagtgctgcaatattagagagtgtgtcataagaggttgtttttattaggttggacttgttcgttggacacactcgaggggtagcactgttccctattcttgctcttagcaactcgataactgcaaaactacaaggagatggccgtaaagtaaagtttgcaaccaaaaatattttcaccgatattttttttcttttcttttcttccccaacaactatcctttgtactttgttcttgtaaggttttgcccacatactaattggtcaactagctagtatatgatcagagattctaccattgtcatgaccatacgtcaacatagagcagagttcaattatagagccaatcatctgtgaactgtggtccactgttaatgtgattatacaatctcatcttctcacttacctttctcctgtattcgtttcttgttttctttatcgtttaattaggactttctgatcgatcctacaaattattgttgtagatagatcatgtaacatatataccggctaacccaaacattagttaagatgaatattttatacataaatcataaaaatattttaatggctataaagaatagtcatgtgatgcttaaaatacaaagaaaaggtcaaaatggtatattcacatcttcttttttcccaatcgggcgcttctttggttaaaagtgaagtatacctcaattgtagttcacttactaaatttgattattcctataattataagactttaataaagagatattaaagtaattaattattataaaattcaacaatttcctattatattatacgtcaaccaataatttgataatttattttaattaaattataatttagaggtttgataaacgaaaaagaatctcactctaattccacttctctcccaagtaattatttttttcatttttcaattaaacaaacatatagaaacgatacacgttaagttttcaaaatcgctcgaaaatagcaggatttctatcaaactaaagttgtttatttttaaaattactaaactagtgtagtttatttacaaaaaaaaaaaaatcaatatgggtaagtcttgcttatattatttatttattttttaccaaatgccaaaaacatttatgactgtccaaaattaacagacattactattataaactgtaaaaaaattgcataaaaagtttaaaaggaaaccatattcatgaagtgcgacttacttatgttatgtgggtaaatttttaaaaactacacttgtttagcaataattttaaaaacaaaatacactaatttggcaaaaagacaaaaacaaagatcgccactggatatcatgcctatttggctcaaaattagagtacgtccaattgggtatcactccttgtgtattactctcttcttttttttcttttgtctaaaagaataaagtattgtgtggttattaatggtgtatcaatattatactaggttataattaattagtgttagagaaaatatataatagcataataatgatttgtgatctcgcaattagcagaagtatgtagtgataaaagctttaaacaacatccacagaacaaacaaacaagcaagtaaaaggtaaacagaaagacgagggggaaagcaaacaatgcaatgacagccagggttctaaatcaacgctatctcctaactactctcttagctaggagtgggtaactgtggaatctgatctttattttgaaaatttagctaaatgggttgtgtttttcttcttgtgtctttgcttttgcatgggattgaggactgatttattaatttctcattattcattccctttgatcaaggggagggaagaaacttcctcaatctggacactaaattcctagcctgctatctatcacaaatcttgggtacgtgagtagtgaaaagctctgacaaaacaaggcatctttaaaacagtgatgttaagcataaaatcaaataactatgtggctcagaggatgccaacaagtcatacaagcacaagggaagaagttactattagtggatccaaaattaaacttttttaaccatcaaattattaattcattagtgttacattgtcccaagctgtccaaaaagagaggcagagttgttttgcgcgcattgcagcttattacatactactgtatgtactaatttatggtagttttaactttaagccctaatcattcaagctgatggaaagtggacaaaaagctgtgtttgtgtgaataaaaactgcaccaacagaaggggcagtgccaggacattattatatgaataaaaattgtgttggtaaggggggctgatatatgctaggaaattaccagctaagaggagatttacttgaattatttatgtcaaattttgtaaaagttggacaacaatacaaagaatagttcttattttcatttatttttaaaatttgaattaggttaattttgatgtgcatcaaaaagatcaaataatttcggtttgatctatatgatatatctttttaattcaattataagttttttgttgaaagtattcaatgaaatgttattgaataatgtaaaaataggtataactaatttgagtcaataggcaaaagaagagtgcaatttgcaaagcaagaacttgagcatgtgattttgggactttgtcacattagtccgaaacctattaaggtaagatgagagtttcttacttgttgttaggtctaagagttataatttatttgacgaattgtaatttttattgttagtttttttattttttggccaactttattttaataaattaatttaaaatattttatcttttatttttaaaatattacaaattttatttttttcccgttaaattgacgtaacatgctaaaataattttactttttattcttaattttttactttttagttaattttgcttcaaacttgtttactttttagtgaattttaaccaaaacttttatacttatgtttcccctaattacacttatgttaattgttaactcaacaactaaaattcttggtaatttctctctttctctccctccctcaaaattttgacttgttttgattcttgtgtttgctatatctgtgtttccaatttatacccctttgattgtgagtgttttctctgttcaagccagccaacaaacttgataatttataatcatataatgataaagagtaaactaatgttagaatcaaataaaaatgttagtatttttcttcctctgattctagctccgcacacacagtacgctcactcaccacactcattggccattattaactaattgaaaccaccagatgtagtaggaagattgagattagttacttgttcgtttggatttttatccacacaatttggatgtacatccaagaaacaactagtagtgcgtgtttggaatttggttaagaggaaaggaattatgtttagattgtgaaagttataattgttaacttttgacattggagacttgaaaaattacatttaaaaccgtgaaaccaaacaagctttgatacaatttcatgtgaaatttttgtgaaaggtgaatgagtgattaggatccaaacatgtacttagtttgaatgatgtgataagaagaaaaaaaaaaaaaaaacaaagtgatttatacttgcagacacttccaccaatcatattaattatttttgtctcctcctctcatctcttttaaggttagagcatctttagtggtagatcttaaattgagatcttagactactttttggtagaccatataatactaaataggattaaagatctcttaaaatctctttcatttttttatttaatggtagatctcattttgagatcttaaggagagagaaaaatgaagaaaaattattttttttaaacaatgtgtagatcttaagagatcttccacaagacctcatctttcatgatggagatctcttcaattcctttattgggagatctaatgaagatcagatcttaagctcaagatctttgcttaagatcttgcactaaagatgctttaagtgacttttaatttaaagtgttccaaccacattctttcaaataaaaattcttcagtattaacaaattcttgataaaatgatattttacaattaagttaatatggttgagagatgttttattaaacgtgatcaattatattttttaacgaaaattaattattaataataaatactttacattaatgtcatggtgagaagaagaatgatattttactgttaagttaataatcattggcaattagtttagttttattcacttggtaattgaatttgaaaagtcaaatgctattgaatagtgtatgagagacgacagtgagacaggagggtaatttggactttggacatcttcatttgggccaaatgatgaggcccacaggctattacaatacgtgaatgttggaccacacagtccacaaatccaaagcatcctaaggtgggttgcgctaaaagtagaaacagagaaagttgctgagcacgtgtggctggcttggatagaaagaacattagaatttagaactagtagttgtgattcagtgcagaagaagctgcttaacataaatgggatttagaattagcggttcctcctcttcatcatgcttttctttgcaacgtacgcttcttcctccgttaacagcgatagccacttctactcgtgccttgaggatgaggaggagtaattgcataccaagttgttcagtatcttatcaaaagtttgttgagtttgctttggatgaaaccaaacgccacactcacttgatcccttcgcctttacaggtttctcttattcctttttttttttcttaaaaaattatggccattttcctgtatgtgttggactttgaatggttgattaggattagttagttccattctggtattgaatcccaagccaatgtgaaatttccgctttgtagttttttaaaacttaatttgcagaattcttcaaaccaaatttaggcagtgtttggtatatgtgtcagctgaaacggacaaaacataatatgtgaattttccttttatgttgcatttaaaaatacaacaggacttaaaagttgaaacaaatgcacattggggttctatagaatgtgtgaaatcaaggagaactgagcgaaatgcaatatttcattatgttttgtccatataccaaatgcaaccttaccttactgatgcatctgtacataatcgaagcaaattttgataaaatactttttttcttttttagatgaaagagttatatgttaggcctttttgccaacatatgtgacctttttgctttataaaaactaatttaaaaaaaaaaaactacgtaccctattgtccggagactccacgctatgcgcagatagggggtgggatattgtacacagctttacccttgcatatgcaaagaggttgtttccagattcgaactcatgaccaataagtcaccaagacacaactttataaaaactaataactaataattttttattggtaggcgtaaaactataactttagtagacttaccctttggccgaccctgaggaagaagagaaaaagaaattgaatgaacttctctatagaacaagttctctggttagtgctcaaaaccaagagattattaccatactttggatgacagtgtttaataaatataaatgaagtaaacaatcactttggtttggtcaatgtttaataaacatcttccatttattatggaagaaaaaacatgagatgaaaaagagttttattatgactaagtgtcatatcttgtccttttatatttttgtgttgccctgttgaggatgtggtgtactgttccaatcaccaagtttcagcttctcaggatagaactagctcttcaattaataagccgttaacttttattttcttgctgttattgagttattcaactttgtatttcgtttatattttgttatagtattattttaaatttagttttattgaacacataattgctttgaagattcttagttgtgaatttctgtccctagttgttcccgactcctctgctttgttcgcttaatttgctctccaccattatttgtgtgcatagatcttcaatctacatttttgtatgttgtcttgctaggaaaagttcagtttcatgaattccaaggatgttaaaggaagtcttagtacgctatcatttgaagctgcaaaaattaggcttctacgaagtttgatcattgagactgaaacaatgcaggtgattttttttttatgcctatcaattatcaaattgatatatggttggtatctactactgtcttaacacaatatgcctttgtgtagtaccttgtaatttattacagcaataacaatttcaaaatttgactttgtctgtatttatttctgccaatttcagttttctttttcctttaccaataaaggatccttcatctataacaatgcatgttaacagaattagtaagcatcctgttgtatctgtttcaatatgcaatctctgatccccatgaggtataacacttgtcggaatatctcataacatcaatattatatcttggaatattttagagtatcttagaaattctcttaggattagcttatgtgatttctcagtttccattttcctaatgttttatattttgcaattctatttcaagttttcaacaacacaagaaaaaaattgacatgtcattgctgaaatgttctgctgtcttctgtgtcctgtctgtggaaaggttattttacaacatgcttactgcctctcttttttgtcttcaacttcttatgcaggttttggattttactgtctttccaaaagcagaatatgatgtccccatattttgtgctaactttttcacctctgctaaaacaaacattgttgtgttgtaagttagcatcttcttccactgttgcaatccacttatataaatgtacaaaggatgttcttctcatattttacttttagttgtggaaaagtctagcaatttgggctatgtttgcaatttttaaacttattcctaaactgcatttcagcttatggaaatttatgcatgggaatgcaatattttcccatccaaaaagaatttaccattaattatgaaaacctatcttgggttgctttgcaaatcaaagtaggaatcattcagttttaaattaaaaaaataagccagcctttgatctatgtgaatatatactttcaagaggtacacacaacagagaacttttatgtcttcatttgggtgtggtaaatgcatatgtttcattgcctactaatactcatcaaagtaggttatcaagtatcaactagtctcagtaacaggtattttattatacttggtaaaagaaaataccatatttcattaggtgtaaatttacttgcataatcacttgaagaggatgtttcattcttttgttaaataggttcatgtatcttttatggtatatttctcattgaataaaagcatgcatttccagaaaagaagattgattgtggaggaattgtccacacgatgaaccaaacggagcttgaggggaagagtgaagttatcattttaggagcagatgtcctagatctcaatgttagtttaagcaagagaaatagtagttgttttactccagccctttggttttgctatttttttttcctatgaaccttgaaaaagatgaagtatagccctaatcagctatttcattctctttaaaatgtgatcttgaaaccatagttcagtaaatttgctatatttgtcatcttaagatatcatatgtcatattctatgtaaaggagattttagcattgaaagcatctttggttgactacttgaaattacattatatgtaccaaaaatgtccttgttggccttcgcttttcattttcttatgtattatagctttacaataaaaaattagatctgaagttgatgtatgctttaatttgaatttgtaggcttttggaagaagattggtattgactcctcttcatccaatcttagaaagaactatttggtgaagctgttataataaatgagaaaaaaaaaatgcctttatcagtaaatacaaactcaaggatttaatgtgtgctgcatgtctactaaagttttccacctactcagatgtggaagaatattatagtgtcatcctttttgataatctactgttagccttcttatgttgcattacttatccctcaatttaattgtttttagtcatattgtcagtgcatgtactttatataatggtacttgggagtttatacttggccaaaataacataatgaaaaagaccatgctttacctagaaataaagcctaaagcaaatctatgtgacagtctgtagttctcatttctccccaatattgtttacaccttaatcgttttagaaatctaatatttgttcactgacatcattggtaatgcgaaaaagttttcccccactgtgctattgatagcttcaaacattttttaagaacaaattactgtatgtaatgcagagcactaaccttgaattaattatgtcagggaccttaaccccttgcatgatatcatcaatcagtatgagtacaaggagaagtactttaaaagcttaattcctcttggccttaaatatgctgaggtaactgcaaatattttagcgaaaattataagaattattggtagaagtattttcagtttagaaacagttaatcactcgactgcataacaatgtgcaaagttttgttaataacagctacttattgacctgattagccacatgagtgatgcattgttctaaaactggatatacttttaagttttaatacgaattctacattttttacttttccatttagtattgattcattaaaaaagtcctcatcatggatgcatctctgtttttctgtaaattatagaaattctttcttaaatgacctagtgtgttgacttaacaccgactttatgcagctttttccatggggagggaagctcacaagtgagtccataaattttttttcgccaattgtcatctggacaaagtttacctcaaacccacaaaaatatgatattttgtattctgcatttagggaatattacaaggtaataaccccagcattatggtcaacttcttgaatgactattcatattttgctaaatactccctccgttcctatatataagacctttcaactaattcactctctttaataaaattgattaatgtagtttgtgacattaaatttgtcaataatttatactattttcaaaattacccttaatattttttaaattaatcatctctccctttccacttaattttttcctccctcattaattaatttttggagatagagtaatgattatgtaacttgtggctactcatcttctccaatcataataagagaaagagtttatcttgttaatttccagcatatttttttttgctaaaaaatttgtagttaattaaggatattttaggaaaaaataattaatacaagagacaagtagaaaatggtcttataaaaaggtacaagaattttctgaaaatggtcttatatataggaatggagggagtataatatatttagtgaactttaataaaactgaccttgtacacgtgtaatttttttctcttgatgactgttaccctggcaggtatggttggaattgatatgcaaagcagttaaagagacagatgaatctcagatttcccacaatctcgaagcacaacatagatatctgacatggagagctgaaaaggtagttcacagttgctaaattttctgacagccaatcataaatatgattgctgatctagccataagcaaacttatatttgtcccaggtataattggtttaggattttctaattcaccaaggatctttactcatttagttagcatcggttgaagataatttagatgataatattaacaaagatggttatgctgaatttgatatcttcaaaaaagctacctaacttattgtttctagagtaatgtagaaagctattttctagcattcaaatctcaacaataaaattgtcaaataagtttggaataaattttgaacttcgaactatatagaatatataggacatgtttggataaacttatccaaaaacacttttaggtaaagaaaataagaaggaaaaatgaaaaagacttctccataatctatttctaattcagttttaccttttaatggacctggttcatggacatacttgaaattaggatccgggacaaggtgttttgaagaagctgattggtgacacacttgccaaggtaggccaaatttgtggtcgatttatttaattcctctacaacctagtaatacacatcctcacttcctgttttatactaggatatgttgagaagctttctctttaatggagtcgatgaacttggaagcaaaacattcaatgattattttccacagtactgctgtcaagagggaattctaaataaaaaaggcaatattattgggaagtcctttgaagatcgcccatggaatgctagaggagaatatattggtaacagattttcaaattggcttgtctagttgctgctttcttttcatctctgcttggtgtgttttttatcctgctcctctattatcattgtgtttatgttcttccatcagggtcctacaagtaaaaaaactatgctgtgacctgcattttcttcttttatacgaaaattggttctgcatatttatctatgacattttgcatgtatatgttcgttgattacttgaagttgcttaactggcagtttgatttgagatgcgagagacattagggcttggattctattattcatgattaagaatgagatgatttcagtaatgaaatagttgtatcttttagcaagctagcaaatacttttgtagaagctagcacttacaagcatactacatatagcggcacaagcaatcttcagaattataatggtatctggggggtgcctggaaaaaaaaaaaatagacttgtgagaaagtagttcacaacttttataagtttaataagatttacagataaacttgttaaaataagttttttttaacttatctcagtaattctgttaattttatgaacatatttttatttggtaggagtatattaaataagtgcttaaatgaaattctttatttaaatgcatccttagtttctttccacagaatataaaaaaaaaaaaaatgcattcttattttataattttaaaggatccttcagctggattgacgtcgatgtgtagcctgaaggctaaggcatacttaccggggtgctgacatttgatctttttggaatattttaggtgaatgactgtatacagtagaagcttgtgcacacgtttgcagtcaaacttttactaggcatgccactggttaaaatttcggcgatagcggttctgcaagcatacaaaagacagctgcaatttttttagacaagttatgctataagatgcttgtaacagatatgctatgtcgacacaaatttttgcatggaaagaaatttctgtaacaaatctcaggctcagcacctatggctgtgcgtgtttgtaattttaacattcgtattggaagattctagttatatatctgcagctgtgtccgattagcttcaagtcctagatatttaagtgtaatactttaccatgcagtttagattaatttgtataacccaaaaattgtcactcgattcagtttttgggttaaatcaagaatttgttgaatacgattgggctatttatttggcatactggctaaattgggtctctttgtaatttgggtctttttgaagttgtgaatttcgagttgatccaccagtctcatttacttatgtctcaacctcaagcctataggttatgggaaaggtagtttataaattatctttaaccttgattcttaatttttggtttactggaacaatttatacataaaaaaaggattaatagcatgttttaccacaattttcattattttacaaattttactttaaagtattttttcatgaattttatcattttaagatttaaatttttatgcattttactgatagtcatgtgtcactaaaaaaagttattttttacaaaaagatgtcgttttgttatcaatataataatcaaatgcaaaaaaaaaagaatcaagtggtaaaaataaaaaaaaaacttgggtggtaaaatgtgaaaatttaaaatttaagtgataaaatttgtaaaaaaaaattgagtgattagatttgtaaaatgataataataattgaatgataaaatatacaattaatcctaaaaaatcatataactgtaaaaaaaaacggtctcctttattttcttccttgaagtacaatcttatgctatatgattttgatcatacgtcttgatgtgcatgagaacctaacttttttgtcactattgtacaaagcatgttgtgattgcagtttggaaatgtccaaatcttggtttaagttaaaaataaatagaagtttctatcaaaatataatttaagatttttcaactgaaatctaaatgaatagtttggatacctcttaaaatcaattttaattcccagaaattatgatgaaaaatttaaaaagttgaagcaattatttgttggtttggcttttcactcgatttaaaaattgattttgaaagaattaaaggttaattcaaacacacacaaagaaattcattttcagattcgagtttcactcgtcggtatcattatatgcggcagcccaacagacaataagataagaaaaaagttgaatagacaccttaaactcttatgtaatacctaaaatgtttaatagagtaaaatatataggtatggtaagattttttatatgataagaaaagaaaaataaaaaagtattggtgagatatttatatatcattattcataatataatttctcaaatccccatgtctttttagatacctaaaaagacagaaaaatagaagaaataggctatgataagtaaatacaatatgataagagaagaaataggaaaaaaataatcatggatctcatgtttacatgattgaggggttgtgaagtgcaggaaaaaataatattactctatttttatttatatcatgttatcacccgcatcacttgattctttcataagaaagaaaaaagaaaaagaaaagaacaaagtaaaaaatagaatgaataaaaatagataagaagtataatagaaataagaatatttggtttgagaacaatagtgacaaaataaaaggaaaatattactatttattttgctcatttttaaggagaaataaaatagtgagagtctggtttttttatttctcattcaacttatttctcctttataaaaaatatatatttcttaggataaataatcatttttgtccatgtctagagtgctgacaaattcgtttataaaacatgaaaatttcaaatttttatccccgaaagtgtaaaaaattcgacaaattcatcattccgttaacttctttctattaccattaatgaaagtgcctacgtgacacagagggacaaaaatgtcacaaaaatgattatcaacgtggctgctaactagattttgaacaaaaatgttagtaagtttcaattggactaaaatgtcagtaattttctgttggacctaaatgtcattaagttaccattagaccaaaatatcaataatttttcatttgaccaaaatatcagtaattttttttggcgaaaaaaggtcagtacgtttccatttgaccaaaatgtcattaagggtaaatcttccctcttttttttttatcattacaagcataataataacaatataataatcacttaaaaataggaaagcaagcataagttaaaaaaaacataatagtcactataatatttattaataatcataatttgtttgtcacaatagaaattatctaaaataaacattataccaatgtaccaaaataaacattgtaacaacatattaatcattacaaatttatttaaattataataattactcacaatctattgatatgcttgtctttccaaaataaatattataacaatgtattaatcattacaaatttatccaaattataataattagtcacaatctaccaagactgccccgccaccaagattcgaagaagtgaaatatgggatatacttgtcttttatttataatatattgtgactaattattataatttgaataaatttgtaatgattaatacattgttataatgtttattttggtacacagatagaatatttcttttggataatttctattgtgacaaacaaattatggttattaatcaatattatgactattattatgcttcttttaacttatatttgctttcctattttttaagtgattattgtattgttattaatatgtttgtaacgataaaaaagaggaaaagatttacccttaatgacattttagtccaatggaaacgtactgacttttttcgtcaaaaaaaatactaacatcttggtccaatggaaaagtattgacattttggtccaattgaaaatgactaacattttggtccaatagtaacttactaacatttaagtccaatagaaaataactgacatttttgtccaacggtaacttactgatattttgttcaaaatctagttaacagccatcttgacaattatttttgtgatatttttgtccttttgtgccaggtaggcacttttattaacgacaacggaaagaagttaacgaaatgatgaatttgtcgcactttttacatttttgaagacaataatttaaatttttatctttcagaaacgaatttattagcgctagacacattcaggaacaaaaatcactatttaacatatttcttatctttctttttgttttgttttgaatctttccctccatttatttcgcaccaatcagaacttttagattatgcactaaacagtacataataaggaagaatcaattagtggggttgtgaagtccccttgttttcttgaagtcacattttatgcatcaatatttctacatctcatgtttacattaatctttgaggtcccttatataattctattgctcaaaactctattattaaggcgtattttcacttatttttctactagtcttttgataattccctattcaaattgaaaaaactgaagaaaaataaagtaaaaacaggttctagctaaagaaaataaggaaaagtaattgcagctaatcatctctttcacacagttccgcatatattctgcaaaaaaaaaaaaaattgtattatactatatgaatgaataattcttgctagctacttcaatttattaaaaaactactatctcctaaattccaacaagaaaaaaaagttcatatttgaattgtaccatcaagtcgtaaagtgatccctccattgttcaagtgctcctagaagagtcaaaaggacataatttcatattgagataatgaagttggaaagacatggtcagaagttacattccattctcgatcaatctatgccatgcgcgtatttaaagcctaaaattaaatatgagggagagagaaacatcgaaggtgcagccagcaatatatattagtatatcagaagcaggtctatatatatagctagggtggctaaggtatgcattgcagcagtagcatgcagcagcagcagctacgatatatcagcagcagacagaaagacagaccagcagaagaaaagcattgtcaagcatagaagcaggagagactagggactagagagcagtagtagaggctaccaccatgcatgtctctacctcactttgtccttcattcattccctcttttaaatgccctaataaagaacttgtcattcatttttatcataagcttttaattttgtaactgttcatgcatgtacggcctttacatttttagttattctgtataactaaaacttcaaaattattttcctgcttacttgcacttgcggcgtctcttgcatttacacttacgtagtgaacagtatttatatgaattaatagaagcatgcttataaccaacgactcaagtttggcaccataatggtgtacgtactcccttgcaaacgcgatgatgatgtgataaatagtaaatgatggggtattttaaaaaaatcacacgtgtgatcaactttaaatttagatgtttattaggttcttttttattaggtataaatacaaattttgagatttctgacagggaagaaaacttaaaaccttttctgtctttatacattttttttttcattcggttcttaattatatggaaaacatttagttcttatacataccaatatagaagaaaacaaaacaaaactcatctacaaccaatgtacactagatgtctcagcaaatttaatcacaggtttggacctttaaaaggatggagtctcctgaaaaaaaataccaatgtcgtttagcacccaaaaatcagattgcattctctcctcttttttatcctccttttacctgactttgaaacatcatgtaaaattgtcatactcacctcaagttatgataatattgttcaaagcttgctagtaaatcaaccttcataatttctcataaatcactttaactattaattaagcaaaactacgtttgatatactctcatttacaagttccttgagccaccatgttaatcacaccatgaaaattgtcatgagttgcttgtattttcttcattcataaccatcatatcgaaaccaactaaaatccaaacatctttgccacatactcaaatgattgataagatagctttactcgattgatatggtgattaataataggtataaagaatagtattagacagttcagtaaaggtgttttaatttgattcagcttagaatggaagagaaaaaaaggaaattaaaaacaatgtagtttgattttgagtgacagagccattaatttctttcatttgatcaggttctattaaataaacttcatttagttaattttataggtcaaaagtcattatcaaatttgctcaaatgcgatgaacacgggtaatatagtaatagactcctgggaaccatgttaaaattagttttattttaaaaacggaacttaatgaaatataaatgtgttttattattaaataactgtaaaattagtatttattcctccaagttcagtgcccaataacatacaataattaaaaattataaaatatgggtaacaagctgaacacccaacaacatttataattgactattggaagatccaagtgaacgcatgcatgctagattgccacgtttttggacttattaaactctcaacatctactaggtgcctgcctcggcctgtcttctacgtagaacaaatagatagtgaccaagggagagaaggaaagattaaatgataatagtaataactaataacaataacaatggatgtgatttttgtgagagagagagataggtacaaaaaggaatgggaagttagaatgaatgtgagcatagtactcctaatactaataataataacaataataattcctaaacctaggtctaactaaggatcctgtacaccaaaatccaataagttaatgttattgtcaatggaagagatagccacgtgtctgtcattggccaccaagctattgacctctccccctctcaccccaagggtcacacacaaccgtcctatcgcttgctcaatgtcccaaaccctcaacgaaggcgaaggcgcaggcgaataggttaacgcgtagccaaggttaatgcaagcccacaacccgtgaacccataataaccggttcaaccgaaaccgactcaaccgctccaaagtgctgactcgccgaaccgttcccacgccgttcctctccaccaccacataagcatcctgactcgcatccagcgaactcaccacgaaccctgtcgtggaccccacgtcacgcaacaacacctccgggttccgaaaactgaaacacaccaacctcgaccccgtgcacgccacaacatactcacgctccgtcacgcgcacgcgccccacggcttcaactaactccgtcagcatatgccaccccataaccgtttctggatccgtcaaagaaccaccaacgaacacgcgctcctcgctccgcgcgtcccatatctgaaaagcccggcccgctatcccagcgaacaggcccacccaccaccggcccgttcccgcgaacccgaccagcaccccgttgttgacaacgtcaccctccacggcccggcgagcgtggctgggcccaggcccaggcccgttcacgttatccacgtagatatccccgtccagcctggcgaaggcgatgttggagttgaagataacaatgcctgagacggagcgtgagaaaggcccgaagaggtggccgtgtagggacaagaaggtggtgacgtgggcccgggtttcgaggtcgaagaggcgcacggtgccgtcgacgaagccgcacgccaggtgggtatcggagagggagaggcagcgacagagcaggttctggaggaggtggtgatccgaagggtcaaacaccggtgggtcgaaaaacctgtgtatccctgtcgagaagttcctggccgtccgatgccaatacatgtactccagctgccacgtggccctcagtcgataggtgcgtcgccatatgcgtctcgtgagccgctgccacagcagatccgaccgcgacacctctcgccacgtggaacatacctgcatgcacaattttttaacaaacctagctgtaagttaaaatagctttctaatgcacgcgaccttgattgataaattaagcaattccctagaattatttatccaaaaatagaaagcagagaaattcttttgtttataaaatcctgttgcataaaaacaaaagaatatgtatatttgatttttgtgggtttttttcttctgaactataagtaggtagaatggattaaaagggtggagagagaaactattgaagatggcagaagcaggtagctactattagctaaagctagcagagaggtactcgggacctaagattattagccttcaaatgaagctaagcttacagtacctagtagtaaatggcttctcatttaatttttatttattattatgtcagtgtacttattttcagttggatactttagaatcttagataataataatgacaacactgctatatggcatgccttacgtatgaaatatgcataagctcctacacacggaattaaattaaacaatccaccatgagctatagctataatcttgcacgatcttattgggctagtgtgattgtgacagacaaattatttgtaacaatgacaagtccatataacgaagtgcaacttttacatactagaataagcacacagaaaagatattctatggatatactatttcatagaggtagtcaagtaattgtcaaatgggtcaaaagggtgagctaggtctgactagtccagctagaatatgagctatctatcaacttgccttagaagagaaaatttaatagaagaaatgcgtagaaggattagaatatactacaatttgaattgagagtggagagatctagcaatgagtgaaaagaagacacagatgagatcagatcatggcttgtataaatgtggtccattacttagcagggatacggcaaaataacgaaactagtcaatatcttagttactgttcgtgtaggcatgtgtgtgtgtgtgtgtgtgtaatgtaaacatgggtatgaaaagcgtgcttccccacaaacatttcagtttcatttccaagaaaggtgtggccaaggggcctgtcttgtttcaaacagcgaatctctagttctatccacgcacacaaggaccagtccaagcgcccctgaagggaaacttagactagcaaaatgaaggaggaattttccttaattagtgttattaaatgtgaaaaaataagttttaaatatggtttgcatatttaataataaaggtacaggtgaaatttttaacaaacaaaaaagaatttttcataggtttatatgaatactttatacattaataattataatgtttataagaggcgttggtacataattttatccaaaaagatccacctttatcgagctgttatagtttttaagtacaaaaaattaaaaaatatgcatgccccaactcccgagtcccaactatgttgtgtgtggtgtgcaattatcattatcataacgtatatagtacacatcatatgatattagtatttaatttattgggaaagaaaactaaaattataataagtgtgaacttctcagataaaaacaaaaggaatggagtgtcgccacgacatgagtagggctccatgtgctttttggcattacacaaatgctgctttttgaccgcatgtatacatgccagtttagattataggatattaaaccgacgactaatcaccggttatttcaaatgtttcaaaccctgattgagattagagaaggtgcgaagtttatgcagcaaccaaatgcaattggtatttcctatcagaaaaaatatactcctatattgttactaatagagtagaaggaactttttatttatcaattggaaaataaataccagagtaggaggacactcttaaataaataatgtaactatgaatctcttctttatttgtgtgagtgtaatgaaaatttattattattattatttttgttacgaattaatgtaacttcaaatctattttccagatttcaattgcttggaagtacatcaactgactagtctaaccaggcaagcttattctttgaacacaaacgaatgattagagaaagctaattaactttcatactacagttaaccttctatcaactatctcaatctcaataatattatatattattaagattaagaaaaagaaatggtgtccttccgaaacattatatattaattatatatgcaaccaaactgaaacaagcttgataaaaaaaaatagtacattatcaatgctccaactatatatggaaatggtacacttacaaggacgctaggaatgagacataaataactatatatgcctccctcctaatgttattatttcagaaagcaacttcttttaaaacaaagtaaaaaagctagtatccacatattttgagatagaaaggcatgcaatggatcttctagcctagatagcagggaaaagctcagtcaaaaaggattcatgcccagaaagggaaacagcaaatcgaagccaatgtaagccttttcattggttgtgaaaaggaggtccaaaactagacatttttgaagaggaagagagaacagatattggcaagaaggaaaaaaaacacccttttttgaaagggacacacatttagtttgaaaaagacccacgtaaagtagctgctttcgcggaacagtttcttctcggttggttgaaagcatcttcaactaaaacctaaatcggcactcatctccccttatacactgagttgaataatgtatgcctctctaaagtttaaacaatacacacaaaaggaaaaaaaatccgaaaaaataaaataaacggatatgatatacacatataatattattaattaagttaaatccataatgtcgatattattattaaaataaaataaaaagaatcagcatctgcaggttgcaatgctaggttcacgtctgacttgaccaatattttgtccagtttcggaactgaaaaagctatctgttacgcatgctgaagattctacaaatattcattttaagcaaactaagaatccatcatcagattaagtaaggcaaacacaaccaaccaatatgagcaatcatcaaaaacttatctttcttaacaacttctctcatagcaagcaaaaaagttaaatggggctaaagaaattaattaagggggatatatattaaggtggtcttcaacctttacattcctacttgtgagacttcgataatacttgtatttcaaagaagaagaaagaaaagtacctacctgaaataaaatggcaagggcagaagcagcagaaagacgaccattgtagttggcagcatcaagggcaagttgggtggccaaagcttcaagaaaaggctcaggcaagacttcattcatagcacgttgacgctgagaggaggaggaagaagcttcaaattgaccactacgggtggttctcctcgtactagggccagggatatcaggggcaacagcgtcatatggggttgaagaagaagttgatgatgatgaagaagaagaagaagaagaagaagaagaagaagtagaagacatgagtgtgtgagtgaagtgtggaggctataaaagtggggaaggaggaccagaccagaccggaaagggaacaaggacaaaaaggttggagataaggacacaaagtgagggacccaaaaggaggaggtgtctgggaattcttccttatactatcatactatgtccatgtcttgtgtatctctaaatctctatacctagctaccactttaaaaccaaacctctgcatacaccatacacctttctccctcaaatttgttccactcttcaataaaataatcatatcgttattaataacaatataataatagtaataatatattattaatactatactatgctttttacatttatgatatttgtggtttctggagatgtttccgcactgcgaggacggctgtgggttggtttttcaatccagctatagcaactcaactggtgccatggtcttcaggtgtttttcaaatgcaaagtggtggtggtggtcctcctcctcaaactctccctcttctctacatttatttctttttcttgatcttctactttgtcttcaagtgcattttcgattcgtcaaattagtttattgtttttaagctcacttttcgattggtggaatttattattgtttttcaaacaaaagttggcatgtgtctagattaacttatttttaaattctttatgattaaattatcatgtgaaagatcccacttgcatgaaagtggttttagccatgtatatatgtataaataataataatggaatggaactgttctactattatttgttttcttttcttttcttgttcacacttagcaacacaatcatactcctctaaaaaaacaaccatacttagtttttgttaatcatatagcctttattaaaactaagaacttgtcattttttttaatctccaatcaatttttttacaaacaataaatatttataagtaaggatgataaaatgacaactcggcccattttagtttgcttggtcattaatctgccaaaaatgggctagaatggattggtttatttttaatatacggtttgaaaaatacagcttgctcggcttaagggtggcttagctgattgactcgcaaaaatctatttttttaaataaaaactaaagaatataaaataaaatgatgtcctaagacataatactaatttctaaacacatttgcaagccaaaacagattgatgggttgatacctttttctcaacccatctaagaaagtaggttcaatggactatctaatagtcaaatctattttgtcacccatatctgtaacaaaaaataaataaaaaatgaaataaagtatttttcttataagtttaaattaatttatgtataaaaaattattttttagaagacaagtttctcttttaggttaaaattagcttacaataaaatcaactttttgaaaagttaaatgaatttttttttcattttatcttgagataaactttttatataaactatttttaacttatagaataaacttatttaatttattttttatcttttaagtatttatgcaaataaaatacaattatagaattttatcactactttaaaatatacaagtaaattcagttcaattgataaagcgcatgtttgtattacaaaattgtcggcggtgtttgaggcagaatttaaaagaaacaccttcgtatattaattaataataataataaaaccttaacttacaagcctatttagcttttgcgttcatttgtttaggaaagagaagaccaatgagctatagagagagtgttaaaaaatactgatagtagcaaacgataatcatttctctttcaaaaaattattcacttttttataaaatatatttttttcatatatggaacactgggtcggaatttagttgtaccaaggggaggtgagattcgacacttattcccccactttcggtgggaagattcaatgcgactaacttgagctgatcttcacgatcatgagctaataaatttttaaaaataaaaaaatctaattattttttttaataataagaaaattaaattaaattttaaacataaattagaggatcaaataaataattaaacctaaattaaattaattataaattcagtacttaactcttattattaaaccataaaccttaaactctaaattttatactaattgtagttagtttttttggttcggccttttcttctttttttcttgtaaaaaacaaactagttattataatataattaacatataaccctatttattaaatattgtaagaaaaactaaataatctaatcatgcataaacaatataagcaattagattaagtgcgaaaaaattaagatcataaatacctcccgtcattgctcactgttttgagtctttggattgcattgaagatctctcttgagttttctaaactcttattctaaagcactagatggtgtatatgctgatgtatataaaatgagttcagggacccaagaaggctgtagacacacttatttatagaccccttgccatcaaaggttcagttacggtgtgttaaaagaatggacgttaacgttgcagaaaaataggggatgtgggtagtggttagtttcctgaattattgttgactactatcaggttggttacaaatattttataattttaaaataaaaaccaacaaatatgtgattaggaatttaatcttaagtttgtttatcaaatacatttattgagagaagttaatttcttacattatctccaatgtaggatcttaataccaattcttacaatcttaaattattagcatcatatgtaaaattttaagtgaaatgtttaataacgatcaattctcatacaattcatatggtaatagagtgcaatatctaactatagccttgctttccacacttgaccgtctttcattacgaaaattccaattaacttttgcactgcgatcattcaagaaggaaagcacaacactagtgaacgtggcctttttccttttaattgtttccaacagagaaaatcttggatggtcagaccaataagcactaagacaaaagtgagcgtgaatttactgtccctcatttttgtgccactattatgaccagtacatatgatttacaataattattatccgttcacaatcgactatctagagtatagaatctattggggggaaaaaatttatatcttccaatgatagtttcaatttgttttattggaaattttttcgggtttcaggttttgatgttcgaagcacatgcataacagcgacaagatccataactttgcaactctaggggccaatgccctttatctttctccatttgttttgagttttcttgagtgtaagtgctcggacagattgaactggggtttcctgatttactgtaatgctcctaattttttctgtaccttatttacttatattgatcagaatgaggtttcaatagaatgtgtacatatatataaattataacctttagaaagaaaaaagtcttggacctttttacttattcaagtccgttattggacctagtctcttcacttttacatcattagaaaatcttcgtgaagtcaagattctaatcctatcacctttaccttttattctttgaagcttttgaatagaataacatctttatcctctgctatttgtccccctgaaatttctattgaaggagaaaaagaatttctagttccaacactatggttccatttgtcactgctgcaactttatattatttaatttaatttgtttaaggaaaaaattactatttcacggatcattttacctcaagagtttggagtactccctctattctttataatctttttgtatcctggcctcaaagttcttatagatactccatccaagcttgacctgcgtgcgaaaatattccattcgaaaatttcatctcaaaagaatggtggtgaacacctaatttttcaaatatcattcatcaataaacctcatatttaaaaattagaatttttaagtactatataaattcaaaagaaaacaagaataggtatatccaattgattttctaattttgtattctagttctacgtattcaattgaataaaacccataaaacacaaagttacacaacggaaaataaagatagtgaccaaggaagtatattagaaagtcatccctcaacaattttatcaccagtttgtttaaacttatttgttaaaataaatatttattttaagaaaataaatttttttaatatatttgtttaaattatttctgcttaaaaaggtaattttttgtttattttaagatttacttcttaaaaaagtatttataaaaaaagatttatttttaagttattttttaaaagtttaaacaaattttatttgcataaatcttgaagaaacccaaaccaataccacatcaacaagagaaaaaacaaaattaaaatgggaaattgaaattccattctctctactatcttgggtgaagggtcagccgtaaatatctcatcctaaatacctccaaacagcgcagctcttgcccccccttcacgttcattattttctcgtgtcacaactcataaaagtatattttgtttcttttctttttagtctttaagtttaaatacaatttatattatgagtccatattttaaaacaaaatgaatttacatgaaatcctcacttcaaaactttccaatgtttcataactatttattttattttttatactaaacatatttttatgctgaaagataattatgttcaaatcatataacattattatatgcaataaactctttttataaacatgtaacatagttgtatgtcaaaaacttagtatgacttttaagtgttttgagagttttttttattaaaaatatagtgcttttcagtagaaaaactatcaaaacgtaatgaaataaggggtgcatttagtaattttgtgttgatggttggatatttttcgtgtaacagctttatattgatgcttattagaagagagggttaaaattggaagttaaatttcataaagagccccaacggaaattgaagaagcaaaagcatggcatcacttgcttttgagatgaacgtagattggagtcaaactcaagtgaaaaaattgtttttaggggtttccaatcatgtgttcaaactgagttttgtgctctaaaagcatgtttgaggttgccccctgaagaaccaaacatgctcttagtatgtacttgaaactcattttctaacacaagttcatgctgtctctccatgttgaaggcgtacttaagtgaaagtttctttttcttgtttccttttggacatgaatctcattgctccaaacataagcaaacatgtaataaaaattaagattgttggttaaacataaacaatcttactctaattgatgtacgagtttggatataattcttttacttttaaatatattgttttcaaccattatacagaacaacactacctacacatacttatacataccatcttatatttacttaatatctgacccttacttaattttacggatttttttagtgaatatgtataatttgaaattaatttaaaatagattatatttttaactgattaaattaaaaaaataattatatattttaagcataatttaggaagtttatgcatgtttagggtttccacttttgtcttcttggttttcccattttcttttctgtctcttgttacaacaaaaaaacgtttagggaatttttgtaaaaggaatatttacctagattcatttttttaaaaagtttttaaaataagtaattattttaaaattaaattaaatgtaatttatttaaaatttaattaatatatttgtttgttattacaaatacaaattttaagaaaatgtattctaggaaagaaattcaattttggaaatacttaaaaaattacatttatttctttttaaagagatgaataaagatttaaacctttgcctccctctgacaaattttttttgttgaagttattttattttttgaaacaggttaaaagaaatataaatataattgcccttttattttactctcatatgcgacgagttttttctgtatctaaagtttattctgttgaataaagtacgatattgatagaggcaagtgcagtcatgtgtgaaaagtatttttctttttacgtacccatcaaatcgttctttcatttgaaaataatcaaaatatgtcactcgagtcttgaccactgaaatgcatctcgtgagcagctttcatagccacacaggacttccatgcgggaaacaactatccataataataatatatctatctatctatattttttaaccatgttattcacattttttttaattataaagatcaaattcaattttcatctaaaaatatagtgtgctcagttttaatccaactataaattcaaataaaacatctcttcaaatttttatcaaaattcatattttgatgtaagttgtgggctatactggatcagataaaataaaacttatattcaattcaaatttttaaaaaacgagacccaaaatagtgaagaaatttttataattgttgtgggtctcatccaaaaacatctcttcgctattgtgataagaaatatacaaaaaattgtctcgttctgtgcgttgctctttttctacgaccacatgtagacaaaacaaaaaaagaggataatttgtcactcttgtcaccacaaattattttattaatattttttgttctctttataaaaccaaataataataataataataagagtatttatttttatctatttctcttatttattcttctgatttattctttttcattttttcccccaacccaacacaccattaaagatcaatctattacattaatcgagatcaagttagatatgacttaggtgaaatgtaaatgtgactacatggagtcaaaccaaaaagtctaccctgattcaacgtttgcaaaataatgtcaaagttttgtgaaataccaatttgcataagttttttttaggttaagcccaaatggttccatgatcatattaggctaaaaaaattaaatttattttgtgctcaagattaaagttcaaggctacaattcattgagtgtgcttcgagttaagtcgtttacatacttgatctggatcataatttataacaagttgagttaaaaagtcaaaatttaaattagatttctaaaatgagatcaaaacacactagaaacttatgttattcagactattgtgacctaaacctaataaaaaaaaagttaaatttaattcataatcaaaatctagagttgaatcttatatttttcaacatgtggattaaggccgagtcaattgtttgagtctattttgtcacctttatgttaaattgaatacttgcaggagatgaagaggtgtgaacgaaagtatcgaagaagatgcgataatattaaaaggttaaaataagattttttaaaaattcattttcactctttttttacccaaatagattttattttcaaatttaaatttgaaaactgaaacacgagcacctacaacagccacaagtaggatattaattgtttatcaaaatgttcttttttttttctaatagaataattataccttttattgaaaatgagattttaaatgaatcttaatctcatcatattttatataaggttccatacatcatatttgattatttttactatgatattaatgtagaatatctacaagttttagtaatgattaatttctattgaagaagtgattgattactatcagtaattttttttaatcatgtttgttattcataaaatttaaattcaagattttatttaagaaaaaaatgaatttaatatgactccaaaacccctctgactagcgaattattgatttacatcatatttgatataagtgatctgaatccaattttattaaggtgaatgtgatattggtataaaaatttattgctacatattaaatacaatatcccagattcccagttgttgtatagtagtgaaaaatcttaagacggttgattggtggtgtagtgttgtgacttgtgagtggtggggagtgtctaaaaagatgcaatgcaaggtgagaactgagaggagaggcaatacggaagaaagaaagaatggtgatgagatcagagggatgaagaaaaaagagcagaagacacggcaagattagattagattctggtgaggtcttaaattcttaatcacatgcggaaacagaacaagaacatcgaagatggagccagccaagccaagcagaaggcacagcacagcacagcagggctggctgggaagctatggcagaatgtgacagtcaaaagcaggaggagagactaggcaccagagagcagtagtagcactgtcagcttctgtctctctcattcatactactactatttttttttttttttcataaacaaataatgaaaaattcttaaaacacttttactaaccagcagtgtcttcaaaatatagttaaagaattaaaatcacagagtatttgttatagaaattacaagagaacacaaaattttatcaataatataattttatgtattttaatcaaaataaaataattctttaacttaatactgattaatatttatcttactgttaatcataaaatgtacgaatcaattagtttaaaattgtctaattagcaatttaaagtaacgtggtgaaagtatgaggcttattaaagttttctctttctttttctttattcttccctactaaaatgacaactaaattattatttgtaaatacgaaataataagatttactttttcctttgtgtattaatataaaattgtcaaatgctttcatatgttcagagtcattttcatattttctacccacaatgataagtttttgtcatatagtgatagtagcatagctaaaacaagaatattggcgtactatgactttctccatgttacgtaaacagcactcttattttgtcatcaatgtatttgtcaatttagtggaagtatatatattttggttggatccgtgtagcacagctaagattttaatacttatgatatcggagtacgtactacaacttctacatggtatatatgttaagaacacactgtttattttgtcacgatgtattcgtcaatttgggactgtttgttataaaattaagtaagattaattttgataaaattaattctaagctactaaaatatattaatttatttaaattataatttcacattaaattttggacttatggtgtttttgaaaacacattaaaaattgcaaaacgttaatccctaacataattaatagttacttttgcatcacttttaatgtgattttgctccgaacatggatctggaaagtggaaccaaacacgtatttagtttttaaaaaaggtatcccattgtaaaattgtaaaagaataaaaaaagaaaaacataatattgttttagttattgctgattagttttttagtttcaactaacaaaacaaataaagatagtactgtttgggttctaaaaagttactatataaactttgtatttaacaataaagtaataattcggagccaaatttatcgtactcctcgttcgaatgacaagagagaaaaaatgacagttacataaattgtttatactattcaattcaatttatgttacagagtgaggtacaccaagtacaatttttacatacacaatgaacattcaaaatcagaacagacaacagaccaacacagatatcttattgcagtccatacacagagagaaggcgaagtcaaatgggtcaaaggtttagagcggtcactgaacctaaaaaagtacgtattcatgattttaattaaacgtacctataattttttaacattatataacatttttaatcataaattaaaaattatacttatactgactattgttgagatgatgattgagtagcatgagatgaattactaggatacatgaattattgtaaatcctagacattatcaattcttacgggtcaaaaattttaaaattatgtaagacacctttgttaaaactttaaaataaatacataaaatacataaaatttgttttgtaaaataaaaaaaaaactatttttaaagtaaaaataatttagacaaatacaataaaaacagaaaataacttattatattaaaataagcatttattttaataataagtttaaacaacctcaccgtataaaaaaaacttacaatattgcatgtttagatacacaattaataaataaaaaattattatatgatatatagaataaataaaggaaataactattaaatttattaatccttcaaaggtttcacaatagacaataagtaaattttataatattagacatatatatatatatattaaaaaatatatttttaattataagtctcagatgagataataaattaaacattcaagcatttaacatatatacacacaaaaaaccttcgttagcgatccaaaaatcaatcgctatataggtagcgaatcggtcgctaattttcttggcattcagagaccgaacattgcagtattctaaaacccaagtcgctatagaaactgatttctgatttactaatacttagtatttcggtcgctaacaaaaatggtccgtcacagagtcttcagttgcttctacattttaatacttgcaattttcatatcagtaaataaatataatttattaatatctaagtgtttattatcttttaataaatattcaatgttaatgatataaaaaactaagtttaataataagttgtgtttctcaagaataaatttattattgaattgtaaaatttaatgattaatttatcattaagttatactaaaaatgtaagtgtcacaccttttacacatttaaagattatattaaattttttattcttttaatgattaaattatcatcaatatatatatccagagaccaaaattattatttacattttttttctttttaagatcaatatattgttcatttcttaaccattctgcattttattaatttctaatcatttttatagctttaatttttttaaattaccttgtgtcgagttataaatttataataatatcttttattttaaagttttaacttgaatgaagttaactattttatataaaggatttaataaaaatatctatatataaatatttaccactattttttcctcatatcttcgctattcctcccctcccttctctcatgaagtgataaactccactttcgtaacatgcatataatatattctcttatgtttttaaaacaactgaatggtttaataagttataaatgaatatcataaatcaattttaaatataatttttttgtcttcaaaattaaatatatttctaacatatgatatatcatgttattctttaatattaaatgaatgtttaacttaattttttacctctttcaatctatcatttttgatatatttagttctaacatgaatttgaatattttttaaattatcaacaattaaaatagcaatatatcataatataaatttctcatcctaaatctaaaatatgatatatatgttataaaaaattatttactactgattttaattataatatcatttatatatttaaaaatatttatttatttaaattttatttatataaaataaatatttattctatgcaatgtacataaatattaatttcaattaaaattagataacggatattcacaatgctccatcattttttttatttgtaagaaaataactagaacggattttatttataactattactttgtttcttgttattgccctcccttacaatcccataaaaatccaatattatccctccctaaaaagcattgtgtttctgttgcacaaaaggggtgcgaattttttgcacaataaaatcattattctattgcataaaggcataacggtttcgtgattccaatgtgcaaaaaattcacatacccttttgtgcagtggaaacatgataatgtaatgcttttcagagagaaaaaaaatatacaataaaatcgtgatttcattgtacaaggagtggttaaaatatgacagttctacgaaagcgtgatttcattgtccaatgaaatcataatttatttttgatttttttcctgaaaaagagaaatgtacattcagagaaaaaaatgtacaatgcgaaatttcgcataataaaatcaagattttgttgtgcatcaacaataccaaaaataacaaaattgtgattctgctatacgaaatttcacaacagaatcatgatttcgtttgaccatgaaaatgaaaacaaaatacttggcaacatgaatgtaaggtggtgtagaaaaagggtagtttgataattgtgcttgtctgaaaggggccaagaacaattttgttgggtcaatagtaacacccaatggcgaatgattgttggaaggggatattggatcaccgaattgggccgtacagaaatgctgttcccttgatagaaatttttttaatatctttgtaacgcttccttaaattccttctcacaatataatttaaattctacttttaacatggcaattcatattatgtttacttataaatagtattatagtaatatttcaatcattttagatcataaaaccttgatggaggctaccttgctctgaggtaagttccatccttgattatgaggacgtcccaaataacagcggaatatagtcttttagtcgctctagtcattatttgcatttttgtttctgccaaccattttagctgaaattttccaaccaaacttggtcacccttgcaagttgcaatatagtactataaaagagcatgcgagtatagtattgttagtacgaaataaagaaacttttattgaattgattaacgaactttacagcgtgattgctcatagcgggccttctcttccgctattatttacaagccactgcccaaaaatatatatcatgaaacacaaaagcctatcttagacgtggaagcaaagctcgataaactctcctgcggtggtaatgagcttcgcagtcaccattaggatttggggtacaagaaattttttggggtggtggtgtggtgtttagatgactgttccactaggaattaaagcatccttgattactgtgacaatcccactttttatgaaatacccatctgtttcccttgcagcttcttggacattgtcactgttaataatctgagaattggaaacaaaccatagattagatttaaaatatcccgtaacatgtcacatgaatgaaaacaaagtatggcaacacagtatgaaaaaaaaattgatatatttagtgagaaagccatttttatcccaatgaagaggaaatccaagtcatacaattgtatatgagtgatcattctcatgatcgagattaaaagttttttgaagatagattattacttaaaatattacatgattttattttattttttaaataaaacgcatgacttatatattttaatcttgatcattcatgataaaatctaagggtcaatatttattattttctcaattgatatgtccacacaaacatataggagacatatcaaatgaaaactattttttactgagaaatcagatctataaatttcaaccatacaactaaatataaatggtcaaaattaaaagttagtgtcacatgatcacttaaaaaaagtcttaattattgtatcattgtgagaaatgagaatatttaaccacaatcatcagataaatttaatgatttagattgcatatttaattacaaatcttacatgatctttaattaaatagaaagaaaatcacacaaattttataattaaatatgcaatcattacttaaattatcaattattgacataaccaacaacttgtcaatgaatgttaacatataaaagagatagtttcttaagtggttttgatactgaattaaaatttgacttcaataaccatcaaccttaactgtgtaggttattgaggtgaaactccaattttgattcacaaaacaataccaaaatcacctaagctactacgcctcacctgttgtcttgggaaaaattggcttagaatgtaaaacaaggaacaaaattgtatataatagaagatgttataaccttgacattttccccaattcgagcattcttgtcgataattgcccttttgatatgagagttcctgcctataccaattggaacactgcctttagcagccagaaacctcttatcagcctccgtctggaacacaacaatcagaaaaccaatgttgcagttagaacttctagtcaaactaaagccaatcgtattaatcttattcacatgcaattgcaaactcacaatcgataaattgaatatctaagtgtttcaaccactttgacatgtgaaactttgttggctattaaaacttggaaaaaactaggtgtaactgagcacaagttatttagccacattattacctcgtaataatctgcccccattaataacgtgtcttcaataattgcaccttctgatatgcaagatcgcagcccaaccacagaatggtgaattttgcagttctatggaacaaagtatggaatacaaggttagtttcctataaataaattattctcattatatttgacatctttgttaagaattgtataaatctcatgtatagagcagatcagtagaatgtgaaggttctgaaatgcttaccttaatcacacatccttcaccaataacactatcagtgacatcagcatcaagcatcttagagggaggcaaatatcgtggttgggtgtagattggagatgaacggtcatagaaactgtaaccaatataccaaaacgcatgaacacataaacatcagaaccacaaaacactatcattgaaatacatgtgtcaatatgatagatatatcaaatagcctatataatttacctgaagtcaggcacaggctttttggtgattcccagatttgcattatagaaagcctcgattgtaccaatgtcttcccagtagccatcatacaagtaagcttgcacctgtgaatgtacacaaacatgccgtacaatattctcaaaaaattgcatgctaaatttaccatgcaagaaaataacaggaaagtttttgtaatattaaataaccggaaggaacacatactctcattccaatagaagtagcaccaggaatcacttcactcccaaagtcatttgcaccaggaaacttctcacggagcaggtctaacatcacatttttgctaacaacatatatacccatgctagcaatataaggcatttcctttgctctctcgtcatcaagacccaaaattgtagtatcaacctagtaaagaaaaatgactggcatttttaagcaattgttcaggtaataatttccagataaataacaacatataatacatcttatacgggcttaccttcatggctttcaactgttctccttttggcttttcagcaaattcaattatacgcccctcttcatcaatcttcatcagaccaaatgcagtggcacgagcttcatccattggcaatgcagccacagtgatatcagcatcagtttccctatgcgcttggataaatttctcgtaatccattcgatacaaatggtcaccagccagaaccaagaattccaaaacattgtgctcttcaaaaagccacaaatactgcctcacggcatctgcagtaccctgcaatgatcacaccaagtttgttaaaacatcaaatcaagggacaacaaaagtcatcatcgcaaggtaccaaaatttagagtcaaggcagtgctgtcattacctggaaccaattaggattctcaggactctgctgagcagcaagaacctcaacaaatccctcatttttgtagccacccatgttgcttgcataagcacgagaaaggtgtcggtttaacgacgcagaattgaattgagtgagaacatagatcttgttgacattgctattcaagcagttgctaacaggaatatcaattagcctatagttagctccaagaggaacagctggctttgccctcttcttggtgagtggataaagccgagtcccagcaccacctccaagtataatgccaagcacactctataaaaattttaaattgcaatcagaatcagaaccagaaccaatccacatccaattcaaatatcacacgatcgaaattcaaactattgtgatctaaaaaaaaccctgtttacaatttgatccacaaatacaccctaataaacatatgattggggatttgaaatttctcagtaatttaatgttgtaacaatggaacaaatacagagacaaaaaaatgaagaaaggaggtaaacgtactctgctggcatcgggatcaaggcacgtttgtgagttttgggaatcagaaactgctttaggagtaacaatcactggattgcgacctctttttggtgccaatgaaactgaatctgtgggaatcttgtctccacaaagttgtgatgcagagaatgaaaggcggcgtggaacgctttttcttcccacatacgatgaaggggaagaagcagaacgtggaacattcagagaacctatagccgccatagatgccattactctgtgtgtgtgtgtgtgtgttgtgacttgttacttgtgagtgtctcagttgaaagaaacaaataagtgagtgtgtggttcagaattggtgtgtgacactgttaatatgcaaatggtgttagctattattatgagccgtatagtgtagatactattacataccttggttgatgattttttttaatttatttataaaaaaatctgtcgttgggggggaaaaaagtaaaaaacgacaaagcacattttcgtaggatagagatggaaaattggaaatgcaatgcaagtggaaggaacgaattataggtggtaagaccgaggggaagggatttcacagtttgaaccgttcttttattcgaaggagatgaaagggacaggctggcagggtgggtaatttcatgcttcaatgagcaccgttcagaatcttgcttgcctcacctctcatccccatgcatttgtcttggtctattctaaatctagttctaggagtaatattctaggtatatatcattctcaatttttaagattttcttctttcttggcttaatccatttcttttccaaccaacttaacttaattagggtacttgattattttattggatctcgagattctcatgagcttcgaactggttattataatattaatttttagttttaaacttccttatatttaaagttttttcctcttcctcaaaattgtatttttcaaaaattaaatctagatcttctttaacaaattcaatttgtgtttgtcaattcagctacattcattggttgggttaaaccaatttaatactactagaatatgccaataaataaatatacgtgggtagctacagtttactaagtaaaaccaattaaaatggggttgcttgcacttgaaaaggctcggtaattatatactgttttattttatttttcctcgttataagacaatgataaaaatgctggaccgactttgctacaaataaaagatacttcaaaatctcttttcataatcttttaattaaaatgaatttcgtattgctagaaattaatagaagaaaatgacataaaacaaacgcctcaaagttcagggcatctatttaactgatgctggatgagtggatgagtttgttgtattataattatccttagttttcttgtactttttcttaaaaaagtttcgtatgtagagtgaaacatgcagtgactaggttgcgttctcattttccacgggagcaattgtatgccacataggtatgacggcttcaatgaaaggaatggacctctctcacatacacgagctcaagcacggacttgaggggactagtgaaatttctcatttattttttctttttggtatttcgggtgttatgggtttggaactttggattggcaattcaatttgctttgctttctttaaaggccaccaatcatagtagggtggtaattattaaaaatgggtgccaaatttctttataaggtatcttgctcgtgaatgccatctgtgcattgattaaatcctttctttcaatacaattccatgttcaattcacctctgtagcgcctctagatggacgatttcatgaagttttcaagttaagggttggtcatcaattgtatgatacgaaaatcgttattatcgaacttttggaagcagaatggaggcatagctaacaaggggtgaaaacaatgacttctagtgaatctgtgatgctaagcttgagtctaactttatatcaattttctgacctaaaggagtagtttcacaaaagatatcattattagttttcttaaaaaattagaagaatgcgggacatattttcttactaaactgtgtaaattaagtttggtgaaagtttttatgtcaaaaaagtttcgtgaaagtattctcttgaatcagtgttcaatttgtaatgcttaagtacctaactcaaatagtccaatattactattgcatttcaaagggaaaagggttacgtatgggaaaagatgggcaataacaaggcccatgtatatttcattttattttataaaaaagatttttttttttttaactcaggaatatccttagtctaaaagtaaaagattaatccattaaaatattaagatagaacttcattaaataaacagtgagatttactaaaaattataatttctaatatttttcagttaaaaatagagaaaatgttagagataaaaactattaaagagagtgttgttaacatttttttatacaattgttattattagttaatttagtgtagcagtaactaagatgtatttttctttatgcattagtgaggtccctaattgattttttttacttatattaattttaaaaaggctccacctcagatttccttttaggcttggattaacttatcaaaataggagttgaggcaaccactttagttaatgaccaatatctaatatccaatagttgagaacttatacttgatacttaataactgacgattgatgacgggttatcgttgatttttgacggttagccgttgacgattgatagcttacggttaatagcaaacttagaattgttagaacaaagttaggatccattaaaattaggttagtgattcaatcaagtgttcaagaggcgcaaattgtttgaacgcacgtggaaagcaacaacatgacatggtcaaatcattcaaatgcacttcccaaaaaaatagaagtaggcattgaaagataactactactttttttcacatggatgggtaataagaagaaaacattagcgaaaaatgtttaaaaaaatgaaatgttttaaaaaaacattgggtaataataagaagataactaatattttatttatttttattcttttgtaagtttatatatttttatattttgatatatgtaagtatttcaagaattataaaaaaataaattaaaatattatacatatcgaaattttaaaaaaatacgaagttatcgaaattagaaataaacaaatattttactatgtatgagatgcttaattcttagcagaatataagtacatatatgaaaatttaaaaagtccgtatttataaatatcttaatttctaaaaataacaaataagtgcaaacaaagtccgtatttataagcaccaaatcacatgtgaaaagacaggttcttaattgttagattggagcatccattgtttgattagtttagcattattaactcactgaccccactctgtggtccacctcagctgccaccatcttttttcttattcttatgtttcctcttttctctttcgcacaaacgcgtacgtagcaataagcaatgaccagaaaggtgtcgaatttctccgatctaatccaaagggtcaccacctcctgcttcctccacccattcaccaatgacaggtctgacgccgacgacagggaagaggagtaccacagcggctcattaggaaacagacacgaagacgaagatgccagcgaagaaggttacttcggtaaagaaaaaatggtgatggatttgaaggtttcaagagaggaaaagaagttggagaagatgagggcgttaatggaggaggtgttcgaagcggtatcggcaatgaagagtgcgtacgtgagcttgcaggaagcacactgcccgtgggacccgcagagcttgagggaggctgacgtggcagtggtggcacagctgaagaagcttggtctgttgagggacaggttccatgggagtgtgagaagtgttgaagaaggcaagagtagaaggagaggaggagggcatgcaccctacgagacactcatgaaagagctgaagaaggaagtgaaggccaaggatttgcaacttcagaaacttaaagacaaagctcggaggcctcagccttacactaagacaaagcttgcttgcaatactcatattcaaggtaaaacaaattaatacgtcatagttcacttttcaaattaaaaactcagttacttccgatccacttacaaattgacatagctaggcggaaaatgattagatgggtcaattcatacaagacacatatatatagtcgagttttttttatatgtttataataaaaaatttaatacaagtcagttgtgtatcaaatgaagattgacacacacacacatatatatatatatatatactaatatacagagagagagagagagagaggaagggagaatcgtgtaatatttttttatggtgtactttcaataattaatgaagagcaatatactcattttaattagtagagtttcttaagtgatttatattattcttataatttatacaataacacttatttatttatttattatattttatatttttctcttttttttttcttaattgtaaaatttgttatacaatttattgtaaaaaaacatttttcttatgtgtatatatatattagaaaaaaaatgtgtttggttagccagaaaattcaattggtatatatgttaactttcttgttcaacgtctagaaaaaaaagaagaagagcatcttaattataccaattgcaaccttttgacattggtgtcatgaaatagcggcagggtttgtagcagcaccatccccagaactcttggaagcaacaatggcgcaagtaaaggaagcatcaaagtccttcacatctctactcttgtcgctcatgcacgacgcacaatgggacatggctgccgcagttcgttccatggaagcagcttctgccaccaccaccgacaaatactataataataataataatatttgttcagtaaccgccacctccaccacggtctcaactcttcatgccaagtacgcccttgaatcatacatctacaagaaaatgttccaaggattcgatcacgaaagtttctacatggataatagcaccctctcctccctcctcaaccctgctcagtttcgccacgattgcttcagccaatactgccacatgaagtccatggacccttatgagctccttggaggagttttaccaacgtgtaattttgggaaattctgctccaacaagtacctttccattgtgcaccccaagatggaggagtcactgtttggtgatttggagcagcacagtctagtctcagaagggaaccatccaaggactcagttttacaaagagtttttgggggtggcaaagggagtgtggttgcttcatctggttgcgttctcgtttgatcctgcgccaagtaagtttgaggcaagtggtggagctgagttccacccgcgttacatggagagtgtgctgaaatttgctggtgggagggtgcctcctggaaacattgttggtttctcagttagtcctggttttaagcttggaaatggctctgttgtaaaggctagagtttatttgatggctagaaactgaggttatatagagactttaagtgctgtgtttgaaagtcttcaaattaatgtttgcttaattagcaggacttacatgcaaagttgtgatatatactatatcgttttttaattaattcatgtttcttagaaataaatagtttatcaattatttgtagtattattttaaaattatttttcttatttttatctatttaattatttttttattaatgtttgaaaaaaaaataaggaagcaaagatatataaaaaaaataattactacatttaaaaactagaaaaaaatcttataattttttttataaaaaaagtcttagatttcataaccaacgaaggaagtataaccttattgaagtgattattacgatgaggttcattctcgaatatgttatctgacactggagctaatacctttccccgaatataaaagttaaataaattattagttcattatatattagttagccggacattttagtttttgatatgttaaaatctttttgttagttagttttacaatttgtcaaatatatatcattcatttcagtactcattaaatttatgcaaaatgattgtaaaattaattgaaataaatgttttttttcctcacaaaattaagaaccggtgaagaattataaaaatcacattgtagcttgatatatatatatatatatatatttgttgttagctcaaaatgacagtcaaaataatgatgaaaaataatttaaataaatgatttttttactaaatttataaataaacaatgaagaatttttaaaatctcattaattaaaatatttggcctatacaattttagtttaaggatttcctctctcacatgggccaacatatcccatcgcaatcaaacaacggccacccagtgtttcagctataacaaacaatcattacgagttttgttgacaatgtgccccacaacaaacgttggatgaatagaaagctactactaaatattgggcattttaagattcacgacaaacagaatcttttagtcaaactgtgaaattgaaaagttaattaatagatgttttaaaattactattcttttcgcaattcaatgttatcacagaagatcaaactcacaaaacagttaatgatacccttgtttttgttgttgttgttgtgattttctaggaaaaaagtgacatgaattatcaaaagtaaccaaagatgtaattttatgggaaatttcattattgttttcatcgattgttcatctaaagatgggatgggaccattctgcttctataatggatatataattttgaaacagtagatccacttgattcggtcgagaccaagatgaaaagcgaagttactgaagaggtttgctgcaatggtcatataaacgtgttaccgaatggtaattaatatatttagttacttgtcctaaacaaatgaaactatataggattcttattaagctatagtagtggatgtgttttgtgttttgtgtatatgtaatttttgtttttgttttaattatctattttccttagtattttaagtatgttatttgtgaggttttcccattagattgtgattctagattgatagttgatccagaagatgaaaataaaaatgaaataaaggtgtaacgtgcttaggtgggtaataagatgttaagtatttgtatcatttattattgtggtcgtattatcatttatgcaaaaagcttgatagatttgttgaaaataactcatttaaagtgagattgtgataaatatatgctcctgcataataattaaattatgaaattcttaactccattgatttttaattaatggttatcatttaatgtgaacttctcacgttagaggagatgaatcttatttgatattgtacaaatgaagaaagagtgcaaagattgattaaggatggaaggcttttgcaaattagcataatttgaaggttgtccacaaaattatatttgagttcccatatccaaatctaactttgctagctctattgtggattgattaattgtaatttaagtgcttcatactctatcaatctctctaaactttgtttaaaacttttttttagtgaaattttgcaaaaatgatagtactttgattttgtgaacttatgaactaaatatacatcattattttataaaatatattacatattccaatcttattacttttgtttctcatttactaagttttacacaatcataactaaatatataccattatattatatatttaattttgtaacttacccatgcggactgtactaatattaagctataagagtgttttttgcatgatgagacataagtgatggttctaaaatgaatgtcttgatttgtagcatttattattaagggattgtgatcatgatctcgtactttacagttacatgagtcttaacatgtgaaaggaagggttctgaagccatcaaaagcattaatatatggattgtgataagataattgagtttagagtaacgatacctaaatatttcattattttaaatattttttgcagactttttatttttctctttttattatatcataaatcctgttatatatatatatatatatatatatacacacatttttttctcctctctcggtgttaaataacataatgagtgtttatgtaatgttttccttgggtttaatagcattgaataaatgtgtttgctttatttgtttatgggcatctcttcccgcatcccaaaaaaatcacctagccaacacctcctttcattttggaaagggtgttttaacctttgtttatttgagcctaagtggtcataatgaggcccagaagaattttccccaagctaatgtgatggttcaattgacgtttattgttattgagctttaatagggtgggtaaagcccttggcataatctttcaagtttcaataatttctttactgctttgaaagtttcattctttgcaaatgtttagtttatattttttcccgtgcttattgttttcttcaaagctttttaaaaattacttttataattatcttaagaatcattcgaaatttacgagtaaactctcaatttagttcttgaataagataaacatggtcactgtagtccttaaatttactgaaacaagagataatcctctgtaacccatcattcaagtaggtcccctttttaagtctcgtttgttcacataccatcctatgtgacacgtctagtaggaatgtttaaatctaatcaaataagaaaaataaaaaaatcgatccaaaagaaacaaaagccaatgaaacagactatttcattttttttactatttatatttataatagattgatttgaataagtttttggttagtgtttttaaaatcgaatcaatccacacttaattgatatttttaggactcgtgtattttatagcacactaatttaacattttttttgttatcaaataacaaatgacgaccaatgacaaatattgaagggaagggggtagggagtgcgaacgggagagaagagaaacgggtgagagggaatggagggtgtgaagggacataactacacaagtaatataggaaattcaataaaaaaaaaagtgagagtgaagataaaaaaatatcgcattgatacatttaaatcagtttgttactattgtttttaattaaaaatttccattgttatcattgaaaaatatcatgtaatccccaaaaatgaaaagtcctgctagtatttcatagcatcaatttggctgcacaacttaacagggacagagattgaattcacattaactaaacaaaatattcattgattaaaaattagaaaaataatattacaaattccaagacttaagatatacacttgtatgtttccaatcatccttgtcaaatggattgtctattcaataaatattgttaacttgatattatatataagatatcatgttgatgatttattgtccaacttaattacattttttgtttcttatgatattgtagtcgtgaggcattaaaattaaaagtgcaagttatcatgcatgatccaatgcaatgttaacaaaattgtaaaatatttaaataaatgtagtttgttttacaaaactaaatataattagaaggactaaaactgcacaattaagataattgaaagccatatttgtgcaattggaacacaagattaaaatcacatttaggaaatcaaagatacaattaagtaaaaaaaaattgatggtaatgacgggaattgaagtgacagaaaaatcccgcggagtggcctcagaatgttgcactacattaaagtataaataaactcgtcctattgttgcttgaaaatagaaattaacaagaaaggaagaaagaagatggtggaagctcgcatgcaaggttcagtcctaaagaacatggttgaggccataagagagatgaaggtgaacgatacaaacttcaatttctcccagatcggcttctccatgcaagccatagatcccacccgcatggaagtggtggatatcttcctccaatccgatgcattcaagaactactgctgcgaccgcaccatctccatcggcgtcaacctcaacaacatggccaagatcctgcgttccgccgccgacgatgacaccatcaccatcaaagccgactatggcatccacttcgccaacttcatcatcgaaagccctagtacgtttgttttccttctctctcttgttagtttaagatttatgcatttccctttacttgatgaatgaaaagatagaacgtaagctagggctgttctaaagattcgtgtgttgttgttgtgtgttatagcgcgagccaagatatctcattttatgatgaatctggtggatatagacaccaagcccgaatgcgtttttcccgaggagctgatttacgatgcctatgttaagatgccttcagctgagttttcaagaatttgcactgacctctctatttttggggacaccggtaattcgttcctatatatatttttctcttttgcatgcatgcataatgcattactttacgttcatcattttattttgcatgcatgtttctaattcttgctgcttcttcattctttaattaattgactttgcaattaattaattttttcatatgtgttgctgtattttagtttccattatggttaacgaagagagtgtggggtttagcagcaaaggagatattgggacttcaattatagtccgcaggaacaatacttccatccacaaggtaacatgttcactagcaccaaattctttcatgagcgttaacgtaacaataagtaatttgggcttatattactctctgtgagattagaatgtgtgtatttgtttatgcaattaatgcatacaggctgatgaggaagctactgtgatagagattattcagactgtgagcttgaattttggattgacatttttgaactgtttcaccaaggcaacgccgttgtctaatacagtcactatctttatgtcgaaccagctgcatctgcctgttgtggttcattacccgattggtgagaagggttatcttcgcttttgcttgaaccaaattaaaccttaatattaggtgctcttatggattttaaattcggttgtaggaagatattttgtgggttaacgaatatggtactcttttacgttttgtgtagttgcattcctttccctgaccacgttattttgcacattattggatgtatattttgtaaaaatacacaacatgactgtgtttgctggtgttgatgtagcatattgtgtagttaacaggaatcgagctttgatgttgggactgctttactttgtgctttcatgtcctttgtggtaggaaaaagagtatatatgtaaagcacttttcagttttagtttataagtgcttttccacttaccgccaaacagagtaatcataatcataaataatatctaactaatggtacgtttgtttcgtaagaatttggacggatggatggaaagggcaccagattgtcaacttcaagttttagtgttttacaattgttgtcacttttgaattgtgcaaaatagtggaagataaaagaaatctaagtgaaacccacctttaaaaacaaatttctatacttgagcagagaagtggaaaagtaacgttttgtttatacatttatcaaattgcccttattttataatatttttttaagaatatttatatcattttatgttcatgggattttaaggatttttttcatagatattcaaaatcatagtcaaaatttacacgcagaagaatatgtgcaattcacctactgtttcattcattctccttatgtgatgatttataacagtgttaaagaaatcaattactttatagatatgatattatgattgcagtgtgcaggaggggaaaggttagaaactgttaaaaggagaaggttataggaagtatttgagagaaatgaaggagacaatatatgaaagaaaattaatttttattatatgagaaatgtttttgttttgaattagtttacaaatgataatttccttgctttttatatgcttcaagagaaaaatctaaaaatatcaagaaaaaaattcacacacttcaagaaagaattctattcattttttcaaattatttatttatacacacttttttcaattatttattaaatattatttttatttatctctacatttttttaaaattttctttagaatagtaacacaaatttaaataaacctaacacttgattttaatggactaaattaaatttatattattcaacagaaatttgtaccaagcccaactccccaaacgaaattagaaataacacaaaatcacaaagcaatggaaataggggtgtgtgaaataaaaactcacaagccactgggaagcaatggaagtcgagagccaaatctcacatcagagataaagcgaaaaatagataagaaggcacatgcaatagatctgtatttctagtttcttaggacatgtttgtattttattaactttccgttcgcacaaattacaaagtgtgattttaatttgtgagaaataacaatttattatttttgtctgaacgaccgctcaaacattaaaacaaacatatatttaatatttgatattttattttaaataataattgtagtcttattcttttttcctcctaaagcagtgtccaacccgtgtccgaatcacaatttttttttttttaatttgatactgtaattgagtattcgaattactttatcacaacatttgtaaatcaaaattgatcatttaaaaaatatagatactaaattgtcaataaatatataattattttttatgactgttgatattaatgtaaaatatccattaattttatttaagaaaatcgaatccaaaattatttagatcaacaacttattaataattctgaactaaatataaagtatatctaaaacaaataacaaacccacagtgtagtttgttaattattgcaaaggttataaaaactgaccgtgtagtgaagaaataactttaaaaagtataactagtagctcaagggtgatgatattttaataaccttttatttttaacacttgaccaataattttttattttattttatttctttcatcctattacatcgcattatttatcgtatcaatctttctcttgtaagaaaaacttttttcaaaatgaaacttaatgtttgaaacctatatggacttccataaagttcacggttccaaagtgttcgtacaaaaattttaagaatgaagaaaaatgctacacaatagaaggggaggagcgccgaggttgctgatagtgatagctattcaatcccttggtttgcaattacattggtgtgcggttttgattctgaaaacggtgattttaccaatctggctttgccatgcatgttagatgggttgggtaatgggtgtcattactcttcaacaaccacaagataggttgtagataacacgcaactagaacaaaatcattactctctatgatctcacatgaacatatagaaactagaacaaaatcatctatgaacataaatgtcctgatctagttacatccataaagatcgagatgaaagagagaagtgcaatcaacaacattcgtaacataaacatgttttaagtttctgtaaatataattatgtataattctaaatttttttgttactttggtgttccttacattttcttagtaatctattttagtccttaccatttactaaatttaacttaatgctaaaaatgaaaaagtgttggcacatctagtttggtaattaatatttaggatacaaaagctgttcatcggtgaagaaaggacttaaaaaaggtataattattagatgaagttgataatgggatgtaaggtttgcacgtttaccaacttccataaatttcagggtactatctcatggccttctgcactgtgttatgctaagagaacgaaagtagcgagttaatccttattattggagttttttttttttttacaaaatgtatagataatattgggagaaaaaaaattaaaaacattaatgcgaggaaccaaatagcctccctttctctattgctcataacatatcaatttaaattagaaaggcacaagaaagtaataagtatagaataaaagaaaaaaaacaaatgttaacctgcgtctttttgttaagaaattagaaggagaaatcttttttttttttttttttactttaattacttatgatgtttgtctttatcggacaattaagtccaatttaaaaagtaaagaaagcattgtgattctcgcttgctgtgatgaaaaccaaatacaaaaaagtgttgccacgatctagtttggtaattatttcaaaggatacttagtagatcaagttgataatgggacgtaacgtttgcaagtttatcgacttccataaatttcagggtattaatctcttggccttctgcactctgttatgctaaaagagaacaaaaataccgagttaatccttattgaaaaaatattacaaaatgtctagataatattgggagagaaaaaaaatgaaaacattaatgcgaggaaaccaaatagcctccctttctccattgctcatcacatatcaatttaaattataaaggcacacgaaagtaataagtatagaataaataaataaaaaaggtaaaattgataaaatctatctaatgatatgtcaggtctgtaaaaggaggtgcgctggaacataagcaatgcaaagaattggataactataatcaatatcacttgcccggaacaattttaacttcagcattgaattagtgctagtttttatcccctataacaatatagacaaataaacaggccgcactatcttgtacagatcgttgaatactcgttgaaacattctccagagcccaatagcacaaaacgatcaaagttgaagtaatggcaatagaacatcagcagttgatgaatatggtacagggatgaacttcaaccacacgtatcaaacttaaataagaaaagcatatctcaaagaacaatatgaaaaaaaaaaaaaaaaatcattcttattgcctccaatcttcactggcataaactgcttgatctccgagctcctcctcaatccgaagtaactatcaaaattcagatggtaactgttatgcttttccttcgtttcactttataaacgagaatagaatacatacacgacaaatatcaacttcatctctacatgagactcacagctattgcttttaatatgcatgttattattaaaagaatcatatacagatattgccatcaagccacatagggtgagaagcctaaagaggaataacatctacagactcaggtactagtacgactgctattaaaacaagacagaacaaattagcatatttacaaactttaatgaacaaaattacaggttataaaatcatcacttaaacactactgatatcacaaatatacaacctatcatagaaaactgccaccaccttcccatgggagaggaattggtgagttgacaaaataagtttggtaaataattttttttgaagtattcaagaatcatgaccataatgcatgcagtaaaaccatcagcataaaaatcagaaagagacctggttgtacttttctagccgctctcctctgcaaggagcgcctgctttaattacaccagaagcaaggccaacagataaatcagcaatgaaagagtctatagtttctccacatctatgagacgttaccaccccccaatgcgcttcctttgccagcttcaccacttcaatgacctccgtaacagttccaacttggttgacctagattacaatggtaaatcaccacattttcagtgtattttcttcaataaaacagaagaaaaagtacagaggaggatatttaaaataccctcccaaatgatttataaaaataaataaaaagtggcaaaactaaattacaggcaagctatgtttagatttctttttcttttacataaactagctttgtaatttacgatcttgtatttgcatgaaaaagatatttgtggatatccaacacctcaacttagatctgaaacaagattgcttccagtccatgaacaactaagtttactatttattattaaaaaacaataatataaaaaaataaaaacatgataagattaaattttgtcattaggcaaaacagacacttgaaagttaattgaagaaacagcaagttaccttaagaagaagggcattacatgcagactcagttattgctctctcaatgcgttttgcatttgacatcaagagatcatccccaactacctgcagaaccattcaaaatgaagggaaactgtaaaaacagaagttccaatcagtagccaatatataaacttaacatctcggtggtaatatgcaaatgacctttctaacgctcacaaccccaataatgtgacaaaagacaaaacaattttatatgatattgtttttcctcccttgttcacatagcctgctaatgagtcaatatggcattgatacactaacaatcagttggttattattttctattaaaaatatccattgctatcattaaaaaatatcatgtaatctccaaaatgataaggtatacttcatagcatccatctttggctgcacaagttaaccaggacagagattgaattcacattaactcaaacaaaatattaattgattaaaaaataatacctgacaaatcccaagacttgagatatgcttgatatgttcccaatcttccctgtcaaatggatcttctattgacacaatagggtattctacaaattcaaaaagaaaaatccaaaataaagacaaagcataggctaaataatttataatgtcccccatcaggaaaatactaagataaaatggtttaccagagcatagttccttgaacaactctatcatatcctctgctgacttaaaattctgtccagacttttgaggagattggaagtccagatcatatcttttacctatatcagggaaaaagcacatacacaacagtagaaactggttaaaattattcaaaggcaaaaggtgcccaaaaagtacaagggggttttaacagcatgaggtgaggcagggtgcatcacagaaaaaggcgttaggggctgttagcaacttagcattagaaaaagaagaaaccaatcaacagtgaaatattataatattttgcagcaactttccatataaattaattatctagtattaatattaaaaataaaacattaaaatgataaattatgacaataagttgataacaagctctacagattaaagttcataacagtcactcatcatgctcatcctattggcttttaaaaatctaaccctagattcagaaacaaagctgaaatgacacccctaaatagaatataaagatgacatattaccatggccaaggatggtcatttgtatttatagtcattattgaagtactattatcaaataagagtactatttttgtatctcttagaaagactagttttattttgctatgaaagcaaaggataattaatggttcatatttttcataaatgacgcagtaaaacagttagcatagcactgctgcaacaaagactctcattacaatagctataagcaaaatagtagagcaagaatcaccaaattccatcttcttgagaatctaaaagtacacaagcgagagaaacttagaaatacctatgcaaaaatttgtagcagcaacatcaagagctatctttattttctcattataaccagttctgctaatggcctccttcacaagatccagggcttctctaaagctgatgatacttaaacagtcagctaataggtagaagtaaaatcaaaatgcttaatataacaaaagatttctttgagtggaaaaatacttaatgtaacaacattagccaagtgcaaatttcataaatattaagtgattttatattttaaaaactatagtagtttggtattaaatctttagttgcttaaaaatttagataattagcttcaaataacattaacaataagcaaaagcaagtacataaaattaatacaaccaaccctttatattaaatttgataatatattctcttgaaagttaacttaatctattaatctactctctcttcttttcatttacaacccatattctttggaattaattcttcatatcatgcttataacttcatcttagattctagttttatatttcacctgaattttaaaatattcatgcgcataggacactagctggttttattaatctttaaaaaaagatgtaatcataattcataacatgcatttaccatgtagaagaaaacatggtaattataacatgcagcagttcaaaatgttggctaaaagaaagtgcaagttagattaagaggcaaaatacaaatgaaattctttccatcacatatttatcatagatttcaaaggaacagggatatcatatcaatgtatccaagaaatcacaacagacagtaagagaaattacagcagtaaaaccagtagtttggagatattttttgtttttctttcctttcttctaaaatggagacattttaccccttttatattattcatttaacagtgaagaattttacagaaatttgtggtgcagtggttccatgtaattgaccccacaaagtggaaaaaggctttgttattgtatttaacagtaaagaattttcaaaagctgtagaaatccaataaaaagcttgcctggagatattaggagcaaagccaccatcttcaccaacattacagttatgtgcaccatatttttctgtaatgacagcctgcccttttgtcatcaacaataattaaatgtatcagcttaaacacgatatcagcaagtgattattaggattttttaatccatcattgatcaaaaaacatatatatgggctgggaaacaacagattggattgtcaaatcaattaaaaccaaataccaccatcgtaggaacagtaagcaacaacaaaggaagactatagtagtaataacataggatctaccgatctaaatcattgtaagccaggtaaacgacaatgtaaccaaactcaatgcaactaaacttgatatgtttctagtttgggaacattgcaatgagtgaaattatgaggagaaaaaaagtccctaaagacagaaagtaaaagcaataggattggataaaaaaagaagaaataaagcaaaaccacctttaagtgatgataggtctcagtgcccattcgcaatgcttcctcaaatttgcttgctccaattgggagaatcatgatttcctaataggaattatgtaagaaagatttcataattaaaagagtctaaataactatgaagcagaagaaacacagattaaaaagaaactatatctgtttatgtttgctcaaaaaataaagaacagaatcaaacacaacaataaattgccaaagttatgccataaataattgaacaggtgttagttacaacaaaaataattgaacattagtcatttaatttcactgttcattagtttctttggaggaaaggaacacatccctaatggaggtaagattatgaaaacacaaatgagaatgtctaagaaattaaacttcaacagaaattatacctgaatggccagattactcccagcatgttttccaccacttatgacagtaaaggcaggaacaggaagtgttgggctggtttttccagacaggtcagcaatatgcttgtaaagtggaacctgtatgtttttgtctttattttcatgatatcatgactgaacatatatactaattttccagattaaaagttaaacaaacttataaaaatattaattgttagagagtcatgcctccttttctgcagcaccagctttacaagcagcaatggacacagctaatatagcattggctccaagttccccctgcagagaaaatcagaaacagaacagataatatatatatatatatataatcttacaaaaattgggagacctatattgctaagatgaattattcaacaagcatgcactagtatctgatcgcaacaagtgtatgatataagaatcaatgacacacactgccttcatcaagcaaccattcaaaactgaaaaggaaactaagtatgcacatactaagtgaagtgcaaataatgcttccaaaatatcttgtatgaatttatcatatttccaacagccaaacaaattctcctactagcctaagggagcactttgtaaaagaaatggaaaatgaagagagagaaaatagaaaagtgaaaatatatggagatgcagaaggaaaactacgaccttcaccacttagagttgtttccgaatagcaacctagcaagcactatcccaattgtatccatcacataactaagaaaaactaaaagttatgtatcctggactaatgaaaaagacagtaaaaccatactattaagactattaaaccttttcatagcatttttcctaatcactaaccaaattcattttgaaatgtaaaataatcaaagcatagaacacaacaatatgtaatacggtaaatcaacagccaattgattgaattcatagcagagagagcgagacgttaaattaccttcttctcagttttgtcaaggtcaatcatggcctgatcaatctgcgactgaagcgtaggatccataccaatcaacgcctcagatattttgtcattgatatttttaacagctttagccacgccatttccgagatacactcctttgtcgccgtcgcgtaactcaacagcttcatacctgaatcgaatcaataacaaaccaaatcgataattgaacgagagcgattgataaataaataataataataaaaggcttacatgctggtggagttgccgctgggaacggaagcgcggaacacgcctttgttagtgtgcaaatcgacttcgacggttggaattcctctgctatcgaggatctgcctcgccttaattttcgttatgaccgattgcactgcttttctcatgtgattcgactgcggtcaccgaaaaaacgcatgctgagaaattccgatgagagaaacgggaaaaaaatgaaaagagatgatgagaggtagagagatacgatgaagagaacgggatcggaggttttggccctaacggcggcattgacggcatcttcgagttttcgggaaagcatgtgcttgtccaggtaatcttgcactgacatctccacaatcagctgcgtcttcttctactctccaaattctcactcacagctgagaagatgtgcgtgcccttgctttcttcttctgctgggaaaacgagattcaacactgatgctgctgcttcgtcttcctagtgtggcagagactagaaaaccgttcttgttaaacgtcgtcgtatcattgtataaacaaatcgagtttacttttaaattttgtttatttcctttattccactaaaatataattcaaatggcaaaaaattaaaaataatacaattaaataaaataatttggcaaatggtgcaaatggaaaaatatttgggaatctggggtactcaaacacgcccaaaatagggcgggtttaacccgccctattttgggcgtgtttcaccagatgttgacacgtggtagtcatgcagacggggtatggtgtgatcgcaaatttcggaaggtcataacttttgactgggatgtccgattgagacaaaatcggtggccacgcgctcgaaattgagagaagaagccctggtcaattcctaaagtgaacttgcccaaaaaattttcccaaaagaggcctctaagtgcctcaaaattgcgatttaattgttgaagctacaaaaaatttcgtgttttctaattttttatctattcaattagtgaattgcaatctattatttatttatctaactatttctcttaatttcgagcattctaacataaaatacgtcatcatcggacattgctacgagaaattacaactgttcaaagttatatgcatcgtcgatattatagtctaattttgttcaattttttaaattatttttgcgaccacaacaacatattttttaggatttatggtttagggtttcgggtttaggatttaggacttagggcttatgctttagggtttagtggtttagtgtttagggttaattaatccaaagccctaaaccactaaaccctaaaccactaaacccgaaaccattaaaaatctacagtaagaaccttgacatacattgtttcaacttatgccaagtccatcatcatatacataaagaagaagcaaaacagaaccatcaatagttaatcattaacccaaagccctaaacccctaacactaaaaccattaacactaaccaattatccaaacacactatctcttagccctaaacacataaaccttatccctctaaaccattaacctaatccaacagttaatcattacccaaagccctaaacccctaaaccgaacccactaaaccctaaacaattaaccaaatccaacagttaattaacccacaaccctaaacaaatgcataaatttccaaaattatactgtaaaatggatgatgcatataactttgaacagtcgtaatttctcgtaacaatgtccgatgatgacgtattttatgtcagaatgctcaaaattaaaagaagtaattagataaataaagaatagattgcaattcactaattgaatagataaaaaaattagaaaataggaaattttttgtagcttcgacaattaaatcgcaattttgaggcacttagaggcctcttttgggaaaaaatttgggcaagttcactttgggaattgcctagggcttctcctctcaatttcgagcgcgtggccaccgattttgtctcaatcggacatcccagtcaaaagttatggccttccgaagtttgcgatcacaccgtaccccgtctgcatggctgccacgtgtcaacatctggtgaaacacgcccaaaatagggcgggtttaaacccgccctattttgggcgtgtttgagtaccccagattcccaattattttcccatttgcaccatttctcaaatttttttatttaattgtattatttgtaattttttgcctaattcaaatatataaagaataaattgtgatatataaaaagttagtttacatttataataattaccttcaaattatatctactcgtcatggtttttaattgatttcaatataaaaaactttaagctaataaagtatagaaattaaactctacctttaataaggataattctaaatattatgctgttaaaaaaaattgatactaaaagcctttaaaaaaaacacaaaagtgcatcatttttcacaaaattaaccgatttataatatgaaaacttgtttagttcaagaccattatgtggtagcgatcttaagcaatttccatatggtgtataattgagtttttttagtttacaccaaaaaaaataataaaattcaattatatgtgtcgcgtgaagtttgaccaagatcatgacggtccgaaattatataataactactaaaaaagatgagtttaagaactccttataaaaaactttcatgtatcaccaattaaagatgggagtgattaacaatgttataagagcaattgtaagccacaaatgactaactactctgatcaattattatgttcacccaaatggaaatataaggaaattggctagttgcagagaatttctaggagaggagaaaaagaatagtgaataacaaatgatatccggtggaatcatccttgatttaatttagtgtattgtgccacagtttagtacaataaaccacaatatagtagaaacagtgttcgaaccattaaacatgtataatcaatcagtatgcccccctttactatgcaactacaaatgcactagatgaacctgtaaagtgatgaattgaacctaacaagcccttggcagccccaaaatgtttgattctgtatacaccaggagttacatcctgtgggattctccattctatggtagctttactttgagaactgagtttgaaaggcctagaccacttgaagcgcaggcagaaatcatcatcatcaaaagcaggaacccaagtatcctttccttggagaaattccaccagggaaaatgtaccttcagtcataaggtcattgcgagggcacgcagaccagaaagtaacagacaccatgtcacctctcttaaaggttgagttcttgggaacatcagagctacaatccccaaactttacaccaataggggttgcatccatcacaaccggtgttaataagcttatttgcttatcaaggaggtcagggggttgtggacctggttctacaggctggccactgatgagagcacgcgcaagcttcgtaaactcctgaatgtaagcactcagtgtgtgtggaccgtacagcgtggacgcaccctggtaacatgaaaattgaagttaaataaagcagcatataatggttacatctcttgccaatatgaagttatgttatttgatgataagttgcatccctaaaaatgtaaatttccactaatgttgcatttactcttgctatagcaatctaaaaaggtttgctgcatgcttcatgtctctttccacaagagttgtaactgacctcatatctctgcacctggtactcttcgtatgtggtcacatactgtgaataactattagtcaaccccgcaataacaacatgaatgttgctaccaaagcctttgctaccacttagcactgtcttcactgcatcacgaagacgcctcccagccattgttgtaaattctgtcagaagtaaaacaattacaggaagcatgaagcacccaaagaaatacataggccagattagattgtctcacaattcacaaatactggtataaaaatataaatatagatctgcaaggaaaaaaaaaaccatatataatataatagcacaacatattaagcaacacatttggattttggattatatcggatcttaaaacatttagacacacaaaaataaatagtgagagactcgcataactaagatgcagccatcctttggattgaacccagtattgctggaatagacatcatcaaaatatcatgatcccaataacggttcaacatttttttttcttctttgactcaatatattctcattcgaccaaggttgttgatgttgaaacttaaatgtttcaaaatgcaaaggatagaaattccaacaataacatcattttaagaaattaaaaataagagctcatacctcctggtacactgagaataacaagctgcccaactcggaggatctggataggaagtattgaaggctgcaattgaacatgagcaaataaaggttcaaattagtaaaagttatcaaaaatcagactctttgtttcagcagggagagcatttccaatcagggccaaatgaagaaatatttcctttgaaaaaagatgccttgtgatggtagcatatctttatggcagaaatgggtgaagagaaacatgaaactaccatcatcaaagaacatcaaatgagtaacttactgcccaatcatatggtaacttcatttcgccagtatcaagcaaaatgggctttgggcggtgacagtctatttgttccttgcctggcgttttaagtaagttacggaccagcttccagaaaggatttccctgacatacaattagaaataataatcatagagtttcaaagatatttaagaatacaaggccaggataataggtaagcataaggtcttatcagtggttacctgatcatcaccttgcttaaagtcaaaagctccaggtccatctgttgttccagcagcaaatgcaaatcccattgcagcagggcatgtctttacaacctcagaagctcctactttagaaggatttacctcaagctgggagaaatctatgaaagcatgtcgaaaatcaaccttccctttaatctgttcagatgctccgttgaatagctccactgcttttttaaattgtctctcccctataatacgtgtgctttcaaattcatctggataactgcaacatcagtttataggagacactttagcaaccataaaggattaggaaaattgtagaaaaacaaagaaacattgagcatgcaataaaaattacccaggtcctcggccatagcataattcattctttcctccacatgtactatgattgaagtcacaaggtagtccagtgtctatacaaaaagctccgagtacatttggactaacatcaccgcaatttgtttgacaaaatgcagaaacaaatctaggcttgtcaacctgcctaaggacacctctcacacgtctagcaacgcttgaagttttggttgcaggtttaccaggaggagattggaatgaggcagcaagttccagtaattcatggtctggaccaataaatttaagtggggttagaaacgtattcatttattaattattattatcatcatcatatattcacctaattgataaactatttatgccacatatataaagcaagatatcattcatgtatgtttcattagttttctcaatcagtcatttagggtatttacatcttgtcttgttcgtagacaactccattaactccaccaatattaggacttatatgagaagacttgtaaaactcagaagcaccggatcagagctcagaatacatgtaactaactacaagaggcaatccagcacgttgccaaagtacaaattttcctcttgttgtttggtgattgctctttctctttggactgttttaaggcttgttgattttctacagcaactatttctctgtaaggataatctaatatattctaaaatatgattagaaatttttatacattctaatttctaacacaaaaggggggaaatcctttggtcaaaccacatttgaagcctttaccctgcaaggcaaaaacattctagaacagtggacccacatcacgtggcatataaacctataaattctgaagctatgtaatgaacatactgtaatggaaaagaagctacttagtttatcaatggatgcattgtagccaaaagcaaacatcttacgattatcatgaaggctgggaattatgtttgaaattcttcgggggattccatcattttcaaatccaaccgaatctattcttacagacccttttcgctcaaaccagtcttccataaatcgtgcagctgcacccttattatccccgctaattaatgagtttgttcggctcattgaagtaccatgagtagcaaaccaattgaaacttcccaaaggaccccattcatcatcaacaaactttaacagagtcatttctttatcaacatcatacttaaatttgcttctctctgcagcaggattgttgagataagcactaggactgcgatttacaccagcatctaagagctctcctgcaagttgaagataatttatctcaaaccatgcgatataatcaacaaagagagggagaaatgacataatagttaaaccatatgactaccaactagtgcacttactagaaatcacattgatagcttcaaaataatactactaaacaaattcttaatacagttaatgatgtcaggaaaagtaaagatgggaaaaccctacatcctataagaaaaagctcaggcttgcctcattcatttatttctagacagttggtgcaacttgcttcttgcagtttttcatctttttctgacatgcttcaacagtatgcaaaactaccataattataataatttacacataacatttaaattatccacctgtgctcacatctgtatacaaatataagtacccaagggagaaaggacaaagaaggaatgacaagtctttcccttacccttattgacaaatattgatcctgggcggagattttcatgggcctgaacaatggttttctcaatgccatcaacaatgacatcaaatgactggcgaacaaatccaagagatgtcacaatatacacaacatactggagataacccccaggaccagcatgagtgtgaattccactaatagccacattcttttcagtatataggtcaccatatctgtcaaacaaaataaagtacaaaatcaggcacaaaacttagggatcaaacaaattaaatggaaacatcagccgcttttcacgctagagaacacaatcgccggagaatcctaaagctcaatatgaactcaagaaaccctggtgagactctaccaatcataccctagtgtgacctgggttagtcatgcctatataacaagtgtgtcctcccacggttcctgcttttttttctggagggtggagtgaatggtgccttagtcacgcgtgaggaggatctagacctttattatattcggccttaagatctgagaggtccgttgactccgaaagccttaggacccctccatagtaaatgctcggacttactagtgtaggtcagccatctgtgacctacttactcggccgaatggtccatagtccctcaagcttctagcctgaaaggcataggcagttatttggtcaactatgcctcggcagcttattcggtcgggtggtccagctgccactcacagaaatataagaaaatctcccatataattaatcttccataatttctacaagttattatcataatagttatttcttgagagcaaagaagtcattattgataccttgctttcagcctctcaattactttgatgactacaagctgtgaagccatgcaagcgtcgaggttcacaaacactacccggttaccctttggctgagcaacaatgaaagcccgagcccgcagcctgaagtgaaccccagatgcaatttgctcagtgttggcataccccatcatgttaacatcagctgcaggaccggtaatgtcatagcttcccataccaatcaaggaatcagaagccgattgcacaacatcactcttcagaagtagcaggaacaagaaaagggtccaaactcgcatagtaggggaagggaactccatgacacccaaattcagagaaaaaacaagaccagttttctttttttaaaaactcggccagttcttctcatctcccttcacaaatcacacccacaaaacttgcagttattacaaaaaaacgaacaacaaaatagaaatgaaagaacttccaaagcaagcaattccaaatttgcaatcagtcatagctagaatataaaaaaatatggttcaacatagaaaagcgtaggaagcaataaagggcaatttagtttctcaccactcagatgaaaagctgggaatgatgacatgagcatgtcgaagtaatctaagttatctgtggattgcagagaggctgccccaataaatgaaaagggaagaaaagccaattgagagagagagagagagagagagagagaagaggcagtgtccaacggagagaaaggaaaggaaattggactggttggtagagacgtagagtggaggaactggcacgggaagacacggacgtgcagtaaggggtcatccaccctcctatttgaaggttcctactttggattgcatggaaaataatttttttcatgctatatgaacttcattcgtctgaaagtgtgacaaatttgtgtgggagatattgaacacatacacaaattatatatttttctcttaatataatttatttttaatcaaagatcaataagaattcaaataaatattaatcatttaattaaaagatataaatcattaacacttacttatgtgtgctgttttggttaatattataaatattactgatatagagtaatatgtaaaaggaaaaaaaactaataatatacattagtttatttttctttataataactatatatcaaaaatgaaaactattatgcatgcttattaaactctttcaaaatcaccacttatcaattttgagctaagtaatacaaaattgttaaataaacaatagtttacattattttcttattttattgtttaagataatgtacatatattaagaaattaatttattatattaattttataataaaataattctatctaattaaaacaccattatttcttaaattattaaattccttatataattgtagttatacttttactagtctatttattttttaagagtgttatgaagaatgtgtccaccttaaaccttaagtcattagtgttacttgcatcaaagtaacactaacttgaagataattgttatgagaattatttcaaccatactattttagatggcatgtgaaataaatgagcacaattataagttgactaaataataaatttaaaaaatatttaggcatgtgactacacttgcgctaaagatgtctatatataaatatatccttgcacaaataagagtattcactccttttcatttattttcctgcaagtatttctgacttgattattagagtccatgtgggagaaatcaccttagatgtgaaaccttcacaaagattccagctctatcctgcatcacaacaaagtgttattataaaacaaataattaatatattttttaaaaaagtgataaataaaaataaaatgagatagatatattaatgaatttgacacactatatgaacacaagtagatctaaattaagtggatcacatatttgcagttagcctataagtaaacgaaagtgttgaaaatttgagggataagaatcatgttcacatgggctaaaaataatgctttgaagtaggcgcagaaaattagtgggaactggtatgatgaattattttgactaaatattgttgccagttgccacatggagtaatggagacatggagttcgatcttggatcttgaagttcctaatattaattctgtctccacttatctgggtttctttttttatctttctccattgaatgggatcaacaactttctataatgatataaaggaaaataaaatatgtttacggttcatgtgatcgattgataataatgcgttggatatagtagctagacatttaataccaaatatgtttttttagaatttaatcaagataacttcggtattttttaattgtgagtgtaaattgtgtagtaggagataaccttttttatctttcaaaagtactattctcattggtggaggcaaaattaaagtttgtgtagttatatttcattaaataaaacaacacttaggtgttcgaacttaaataacgataaaaattgaaagagaccataagaaaattcttcccgaatcaattagtaagcttgtgatatgtggacagattcattggtttgaatctgaatgtgaatcaacaaagtatatgttggagaaataaacgctttataaataaagctcaaaagaaaaaatgatgaaatacttcgaagttttcttactctgttttaagtctaaaatattttatgtttctttggaagtaattttaaaaataattaaatatatttaatttttttagttcaaatatttgagacattggatagtatttttttttcaaaattgttttatgcaaacagtgttcatgtattcaatgttttgatacatcaaacaaatataaaaattattcaatatttatttaaaaataattaacaatattttctaaatatatttaatattatttaattaatattttaaagaaatttgttaaagatattttcttaagatatgtactccatactttaggcaatcaggaatgacagattctggccttggaaaacattccaacggatgcgtggaagtcaaggcattcacacaacacttggagagatccaaacaaaatccaaatatgctccattaagagtaaactagaaggatcatcgaagctgtcgtggcccatttcctttaactttttcattatattttcttttgtccttttcgaagaagaaacaacttcttttcacattcaaaattcaatagtggactccaatcataggataacattaaatatatacaccagcactaaattctttcatgtgcgttacaaaatatctataaacacgcgaaattgataaaaaaaaaaacccaaaactgcttaaactgaaaattacaaaaaaaaaaaataaaaaccgtatacttttagtggcttggtttgattttttgatcttgtcattaaaatctaaccaaataacacattacaattatattatttcattgaatggatgtttaatattatgtagacagtttttcaattttaattattatagtatgttatttatagtgtatttttttctataataagtttataatatatatatatatatttatcataataattaataataagaattaaataatttatgatatttctttttgttttgtaatcaagatacatatattattttcatatgttaaaaaaagaaattctaatattatttaaaattagtattaaatatcaactgatgtaaaatttattattatgttatgaaaagagttatttttaactaaaatatgtttttcaaaattaataaaaaaatattttcaaataataaaacataataataactatgtaagtttgatcaataaaatttagattgtgataataacttaaaaatataaaaaattgtcaaattaaactataaaagatttgttttacttaattcagatttaatgatatatctaaatcaaatcgcatctttttattttatatttatttttgattattgaaagtaaacggcacccgaaacacgttactgtcaacgcctcagaattaactaaaagaagaatttagcgaaaattaaaaacctataaaaaagagtatagaagtggaaagtgaaagagagggcgccagttttcaaatactacaatggggtccagcttgaacaacactagtccaatctctctaagtctctattatccgttccgttcataaatttaaaacttcgcactttcttcttcttcttcttttcttttttctttttttataaaggacgcacttactcgtactcttacccctgttttttctcctctcgtaagaaacaattaaaaataaataaattcgccttctcgtcggcatcgtaattgtggaactagaaggttgttgcgccttctcctccgccgtgcatgagcttcctccgccgccaccatgccggcaaggcgtccctcctccgatctgatcctccaccgtctcgcctcgtccgactgcgaaatcaagctcaaagccattcgtgaggtcaagaaccagatcatcggcaaccgcaccaagaagctctcctatatcaagctcggcgccgtccccgccatcgccgccgctctcgctcaagctgacgccgattccgcctccggctccacccccatcgtccagtccgccgccgcactcggcagctttgcatacggcgtcgacgccgctgtccgcgctgtcctcgacgccggagcattccctcatttaatcaggctcctctctgccgctgacgacaaggtcaattcgattaattacagcgtttttttctttttgaaatttcttttgcgtgtttggtttctctgacattggtgctaagatgaaattgcaattgtaagaagaaatcaggaagcactgcttatattgcattgttgctcatgttgataaattggaaattaggaattgaatagctcgcgtgaaaatagctatgtgcttgtctcataatcaacaacagtttgtagagtgtacgcatgctagattgttaagttgcgagttgttgatgtattctatttctctccttttcttgctaggtttattacagctaaaactatatatatttctttcttagtgatgaacgcggtacactgattagagatagaaagggatagaaaaatggagcggtagagtgtttgcgaaattcatctataggtagagaaattggaagggccaaaacttggatggtacaattggaaataaagaggagtccaatggttaatctcccggtaacttatgttttactaccgttacatgaagcatttttttttttttttggaacaaggagactctctaagggcagaacttttggctatagagcatggtctggaagtctgttggaatcttggctattacagtgtggtgtgcaaaacagactgcaggaatgcagctgaagaatctatggaagagtgaatagattggcatgtgcatggggatgtaatttgtcggattcaggatttcattgggaggggctggaatgtctcactcaatgtggtgtctcgagacattaattgtgttaccgatttgttggcttggtggggtacaaataataggtgtgcgacgcatgagtggaagctgccacctgtctttttctcgttgcgttaggcactgattctttgtctctagtttagttcctttgtatttctttccgtacatgtaccaaataaaattatgattttgtttggctgcttgcagtgggcatttttgctgttgacaattcattttgaatttctttttaagaaatttttttggtaaggataacagaagttttacccgctcttcttgcatgcctatctctttacctgcctacaaatacaagcaaatatacattgatttgcacttcttcctttagttttcacctatggtaaaatcatccttgatttgaagaaatgtatgttggcttctaattaccagatgtgttgaagagtccccttgatttgtagacacaacctcttcatgaaatatcaaaaagccaattaatttatgataaacagcagttgtgaggggaaaataaatgtattatgatctaatgcttctataatctttatgaattggctgtaacggtgtgtaggcattcattctagttcaatgcagtcagtggggtgtggacatgatttaccaagtattgtcactttgtatatcttatatctattccgttttaagctatttgctttcatattttagtgctaggatgaatggacagaggttacaggaagtgcatttgttattgtttctatttgatctttaaatgttgaatatttttcaagacttctttatgccttttattcatttgtggcatgtagtaggtagaacaaacataccagtccttaacccttatacattaattatcattgtgataagtatgtgatatgactgtattttttttccaaatgtcatctaatagacctgcctccccttgatttcaggttgtggatgccgctgcatgctctttatgaatgatttatcgatcaaaactagctccaaagtatgacttttttaaagaacaagacatgcaatttcttctttcactattgaaaagtgggaatgaaaatcttactggactaggtgcaagcattgttattcattcttctgagaaaagagatgaacaaaatatgttatgctgtgctggtactttagtttagaaacacttattagccttcttgatggttctctaagccagcgagattctagtttagaatcccttactgcaattcttaaaaacaatccagaagttgtctctaaatttgtggaccttcaaaatggaagagctttgagttcggtaattgaactaaccaaggacaggtattcttggactaggttactagcctgcttgtgcctgattagtgtaaagaattcatcttcttgctatctgcaagacataggaatcaaagccaaattggtacatattttacttgagttccttgatgattctggtcaagttggagacaatgcttcctttgccttttcaagtttagttgcagaaaaagaagatttgcagaagttagcatttgaggtacatgctattgataagttcaacagtcacttgcaaaactgtgctttacatcccaaacaacttgaagggatatttctaaccttagcagattgtaaaacttttgaaacagtcattggtggaatacaggcattacaatgtacattggtatcaatgttccaacttaatgatacatattatgattatgttatggtcctcctttttatatctccttcctccctccctctattttgggttgttatacaataggaggtgcaagcacttgggttggggagaagggaaaggtttcatcaaatgtttttattatgttgtctcatgattttatgctagtgttctgtcagagcatagttagtactgtatggaaaagctgttttacccatatggcagaacagcatggtgaattttttaccaactgtcataataggcaatttttgaagggaggcccactgtggcagtgctataggccgcaattgtgtgtttgtatggcggatttttggctttctaccacattctgccatcccccattgataacaccgcaattatcaagaatcaactatcccaaattttttaagttattagataaagacactagaatgatttttatatgcatgcttcctcatgcaaaagccctatgggcttgaagcatggacaatgcatggtgggggcatggtatcagagcctctatgtccttgtcatatttctaacactgtaaatcagttgcataaaatgtttatggtgggcaacagccaacaggagatccaccttcatcatttttccttacttgtatggttcaatgaagtcatttttgagattaatatctatacctttagattacttcattttgagagcatggttctaacgttctgttaatgctatttgggagagaaaaatagaggaaattaataaattttggagatctcaaaggaaatgtaaagggtgaacaaagtatttttccctgacaggatagaaataacaaattaacacaatgagcatatgaaaaaagaaaactgcaattgtattgaaatcttaatcttcaagctgattatctttttattttgtgtaggggatgtacttactcagcaatattgcaagtggaaatgagtctcataaagaagctatcatgcagctactctctacaaaagcagaaaatgtgtctcactctttcttcaaccagtttctgcagagcaatgacagtcgattacgcacatctgctgtttgggtcgtagtaaatctcacttttcctgcaagtcctggggcatttggtaggattgtaaaactgcttaatgtaggcattgtttctcaaatcaagaagatggtcaacgatccttgcatggatgtgaaggtcttttaatcttcatttcaaactggtcttgttctatactctctttggagtcaaacataagtaaagaataactaattctcgctaattaagaatgttagttaacttcgtttaattttcttatatctcatttataaaatgaacttcatttcctaaatcatcgttcgtgctaattgatggaagacttcaattctctgggaacatgtttcaaatgggaatactctctccattttaaaagccatgtgattgatatcatgagaataaaaggagccattgaaaataaaatttgaattaaataaaaggcattttgggaatgatttcattaaatagggtggaatcaattaagattggcttatattttggaccactatacctgagtttagattcacttatattttggaccaccatacctgagttaagatttgcttatatttgagtctggaggaaatacttctcttagttattttgtagtttttttttttttttgatgcagcttcgtgcaagacaagcacttgggcagattattacttttggtgatagttaattgtaatcagttactccattcaaagcccttgggctgcagggaaaaagagaaatctcgatagattttattttctcccaattcccaccttatatgtaaggtgtatcggccttgtgcttcagcatcaagtatggtatgcttcagtggatgtatttcaatgacttccttgctgtctttcctagaggttcatttctattctatttatgcaggccactggaaaactttactaaatatgctattgaaaattggaattgttgactgttatttagttgttaattcctgcttaactttaattggttaatatgatataaagttggttgtagttaaatattcctatataggcacttcataaggatgatgattctatttctatctttgagatatgttcatatttatttaggctcaactgcgaagtagtcttttagttggggatgaagatttattttttcctcattatttttcatacttgctcgcccctgtttttagctttattttttgttctggtactagtttatcaataatatgtttctcttgaagttttttaacaatatgtatcatgttctactgtgtcaaattgagatacatggtttttttcttgtttcgctttgcaggtgtctaaaattacttgtatttttttgaaccagtcagagctgtgtgtgaagcactcctgaccaggttgccccgaagtctctttctctttcgctcacattgtgtattaccttttgtaagtcggaagatcgaagtagatttacaggctttagtattgtactgagtagtaaatgccaattttagaacttagtttcaatttcattctgatgctgggatattgacaaatggttggattctatgtgtaagcaacatgtcaaggggtaatgattgaggtgtattttgtaaattattgtgatgttttaatgaaaattctttgcgaaccatacttttttttgttgacagaactgcgaaccaaacttagcacttgtactttatacgtaacaacacaataatttacaaacaatgtttttttaggtatataatttaaaaaatgttgtttttttgcctttaattaatgttatatacatagccatcaagataatattattttaatttaaaggtagtccaattatattctatttgatttttgaaataagaggtatttaaattttaaaattttgaaaggtgaaaacaatcaacttgttattattcaaaagaataagatatgattccccaaaatacataataagataagatctattgctcaatttttttctttaatttaatttaactttgatgacataattctagtaaaaaagaatgaatttggaagaacggggggcggggaggaggaatatatacattaagtgactttgtattcatgctgtttgcatatgttgtcttttacagtggtagcatacaagtaaaagaattaaattagaacttctgtttgatttttttccttaaaaaatctttaattgagtaatttctttgagttaaatgagtagtaagtataatacaataatgtcttcagtttttttgaatgatagtctaattttgtttctttatatgaaaaacattttgcgaactttattttacttactaaaattaaaaaataagcattttattgatgaggaaaattaataattgaaaataagcatgtttttaacttttgaaaattactttcaattaaactgcacttctacttttttctgttcgtgataattgtaattctgcttgaggttgaatcatacatcgtgcaaggtattgagtaaaccaaccctgtggaagaaataaataatttctttacttttccataaacttccgaagctaacatggctaatagattctagcgattggttacactcaaacaaatgcctaaaatttttaatccctattgtaaatccttcatttcaaactatctaaataatggatcttatatggaaaggtatagagatatacacaatttacagaacgtatcactagcaaatctagtaagagaaaaagatacagataaccaatttagagagaaacagattgccattggaacaaaaaattatacctagactagggagaggtaagattaaaagacagaagggaaaagaagagatcgaaagtcctaacttatcagccgattttttcggtgtttgtgtcatctgaaggccatattacagtttccatgagccgttccctcatcaactccaagttttcatcagatatttcttgatatatctcagcgtgattacatttctgcatggcaataagaggtgaagaaaggttataatttggagtgcatcacccctttacagaagattatcacatgccttggagatcaaacgaaaagattgacatcgataattttgagttcaattaccttgatccatttgccataaaggtgaagccgtgttatcatcactctttcagcaagttgatgttgctcctagcaatcgagccaaaaaacataatgacatcatttccaatgttatcaggtaacacattgtgaaacgtaattatcaaaacaatatgtttttatagaaaattatatgaacaatatatcctgtggaaaggcattagacaagaaaattggaggtattgaatggaaggaaacacaaactgatcagtagtttattaagctatacaccgagtaattcggtagtagtttattgtgaaagtgttttcagcactgcaaaaagaccatagcatgcttacgaggatgatatttctttaaaccagcatcagtattggaaaacattgtggcagtttaacatttggcataggaagaaaacgaacagaaaaaacagcttaaaatagcaattcttgagctgcacttgaaatgttgtttatagtactttttaatttcaaaaaattaaacatgtaatagttcacaaaattgtagtaaattttcaagagagtaatcaaaagacaaaagactcaacttcctactctgaaaattatcaacaaatgatataactgagcagagcacatacctttgtgagggatcgtataaaatgtttcctatctgtcgggtcgtttgttgcaacgaaactgttatcatggaaaacaaccaacaattagctaaaaaattaaccttatactatgtctacaaaaagttgattaactttattatttgcttgtaataatctattaaggtccaaataaatgttgtagaaaactagaaattgcgaaaggtatcgatgtgcatttactacttgaccgctttatcgatcaagattcaagacttcttatgcaaatagatttcctgtattcacacattcacatttcggatacatattttaagctagattcatcgagataaaatacgagtctgtccgattttcattcaactgattagttgaatgcgtgaatgtggaaattccccaactgcagagaatcctaattcaacttttcataaggtgcaatcagagcaacttttcaactgggatcaagaatctatctatgagataccagttcaagtataataatcaaaccgaaccagagcacttccattgctggcagtggcaagttttgagagtagtaaacgcacacaaagagttctaattttacaataattaataaaaaaagagatacttacagttgaatgtatgcaatcttctctttttcacaagttcattcagtcaacaatttagaagcttacttaacatgtgactgaatggaaacatcattttttaaactaaaataaatagtaattagaagagcatagaagtttgagtggaaattagcattgtagctacaacaacatagatttcacttacttatagaaccacctatactgaggtgggttcatctcatacaactgttgaagaacagtcctcacagccttgtatgtgaaataattgagtatttgctgtatccaaataaaagatgaagccagtcaaattgcaagcaaggaatagtagtatactcagtggcggatccagaaaaataatcaagagagacactagtagcagattcaggagaatttatttatgtccgcacatttagtggcgggattcgggggcagcgcctctgcaattttttttttgtaaagaaaatttaaaggaacaaacaattataaatcataatctaaaggaacaaacaaataatcagaccaaattattattctggattgaatagaacaatgaaagaaacttattgaaacttgcgatgagatttcaaaagaccatgatgacaacatgagagttagtttagatataaatattgagtttgagatctttgaatatgaaactgttacaagatagactaaatatttctacaaaatacatatggttaaactgtacttctcatttcaatgaaaataatgactttaatcatcttataaacaagtactaatacataaattacaaatgaaaataattaacaaatactgcaaattatataataaacatttaaaataattaataaatactataaataagtactaaaagtatattaatattttaatgacaaaatttaaagtgtccccaacttataagctagatccgcccatgagtatattatatacacatagcaaaataattaattaaatattcattcacaatgaccctggagaaattagtaaataatctcggatcatcatctgactattaatgtctatatattaacagaaatattaaaactttacaatttattagaagaattaataatacttgatcacatgtcattcaaatattcacaacacattatagtttcggactagctaagaatttatgaagggagtgagtatgttaagtagcagtacctttttgacatcatgaaaagtgtcctcatattgaccaccgagctcattgacaatagtgagtctcttagtcttgtccttgtgcctgcgatgcttcttgaaaattgtattaacactgtgactctgaacgaaggaagtggtgagcctcaacctcaacaagtgcttcctattgagacacaaaacactgatactggtactactagggctggtggccagagcatccacgtacaaacgtgggcaactgtgccactccaccgcaacagatacaccaccaaccatcctatcctatcctcaaacacagatgaatgatagaagatgcatgctcttttggaaaaccaagctcggatttttaagtgaatcttgaccaaacaattattctgaggtcctaaattttcaaactaacgttgcctttttcaattcagttgcacacttgggtttgtcaccaatccacgcacacacatcgcgcgtgacatttaaatatgatcgatcaaggaaaagagtcaactgagcatacatgggtattgccttttcctgctaagtgctagcaactagcaaggataacataatggaattgttcaactattattaatgataagagaatagaatctagatactttgattttttatctttgtttttgcaaacatattctaatttatatattatatatgctaatttgaattgattaatagtatacactaaatataaattctacttttagaagatttctaatcatgttataatgaatttggagctagggagacctttttataatttttttaaagatattattaatgtaattttttttatctttcaacaaaaatatttttacttttaagtttattgactaatgtttttaggatatagtgattaacatttgtcttttttctaataagaaataaaaatgagaggaacgtttttacttttcatgttaaacctctttgttgtttttgaattttgctagaatgagtataagatgaggaattatggtgtaatcactaaaaatccccctttttaatcaacattttaaagttaccccaatttaaaagaatttagaagattttaaacaagcaagcagattataaataaactctatactcttccctttttttccatttccctctcctccgacctttttagtcaatgagcatatactcctcattttatttatataaaaactcctttttgacttgtgtttatctatccaaaattgattagaacttgcaaaaattcttggttattgtacctcaacagtggtaaatgtggcatgatatgcatataatatatgtacaaattaatgtataggagcaaatgcatgacccacgtctgtccaaaaaacccttctagtaggatcctatatatggagaagcaacaaaaaagcaatttgaaaactctgtgaggtgtggtgtggtgtgattctgattagattaggtgatgccacgaggactagaagacaaaaactctgctatttttcaacgctcttaatcaattaaataattcacagacaaacatatcagtcagtgacagtggctgaatagctttggatcaatgaacaaaactctgcttctcggccacgggccactcagcgttattggttatgtagacagataacaaaaaataattattatattactatctatccttctcaaatctcaactgttttattcacttactacattttaatttgttttatgcagaacttaaacatgttaaacatctgtttgcattaattttccatctatttacaaattaactaataaaaatttattttaattcagatgaaaaaatatctacaaattaattaataaaaaaatattttaatatataatttttttcttctcctaaaaatatttttcaaaaaagcttattcaaacatgccagaattctactaagattagtcaaatataatttggaaagaaaattaacgttaagtttaaaattgaaagcaactatcacacctttatttgtaaaatgaagacacgtatagctcctgtccctcccctctttgtctttagttgaagaattgattcattttttctgtcacgtatgttaattattagcatgtttggattagattttttttaaaaatcatattgaaagtcaaagtaatatatagttttaatattttttttctttcaaaatttcaccttaattttgggtctcagaattaattatagtagctatccaaacaaaatttatatagctatccaaacataatataagtagtattgttatttaaaaaaataaaagttatatgttggactagcgtactaagttcaaatctcaccttgaaaagaaatttgaagttttaatattggactagattttattatttttaaaagtatataaggatctgatttgagaaaattagagaccaaaattatccctttgataaactactaaaattacctttaaaaaagattttttattttccttcttaatcacaaattttgttgttgtaaaatcacccatttgatataactactaaaaccactcatttgataaattaattgtggggactggtaatacaattaagtctttaaatagtgataaaaaataatttagttattaaatttcttgatttttgcataaaaattaattttgttgtatttttatagttgataaactaattaaaatagtgttgcagtttttggatagctaggaatgttattttgataataaataactttaattaaaaatgttacgactttcaaatgactttacagccaatagaaagggataagtggagaaaaaaaattattttgaataaatgtggttgaaattgtttcgtactctttgtcatttccctttttaattaaagttcaaaatttattaaggtcttaaaagttgtactaaattttgaaatctattttgataaaggtcttaaagttcaaaatctaaagctacgtgtggtagcctacaaactaatgtgtgcatgtaattaaaaactccaaaataaaagaatagtgtggatgtgtcaccgaccctttttagtgatccaaaaacttaaagtcatcgtacaccaaatataagtccaataggtcccagaatatttgaacgagccactttttcacccctctttgtcggccattctaatttataaccataatataggcccccaagacaagacgtatatatgtacgagtgtgaaaatctctgcctccaattccttctcctttttccctccctacctagggttaaatggaggtaaagcccaacaaagagataaaaagaatacagatataatactaattaatttacgtactttagtaagtgttagaagatttttccttcgtaaatgtgcatgagagagttattattatacacaactttatttttatatatattaatttggtctccttttaaagaaatcttgtcgtcttggattccttatttcatcacttgtccattctttagtgtaagtgtcatagtaaaaggagttgctttttcggtgtcagctactacacaaaatgttatagattctttcttgaggaatcattacttcatttcttttgtcatacgagagataaacataagaaaatttacatcaataataaatcatttataagactacattttaatcaaaaacttgaagttaaaatttatgaatctttttcacagtcatataatattcaaccttttcatttttattcaatctaaagcttcgtctcatacacttattacttcagcatttacaaaatcctcttttggacaaatatatatcatttccattttaaagcactctccaataggataagcttgtgtcctctcctgttacactagttagttatatcttctctacctggttaagtctcaggcttcttcttccaattgccagctttttgttttagaaacatttaccagttcttttaattaacctagcttatagctagctgactcacacaagcattttctatcaagacatggttccttctggaagtacgacaaaaccaacaacttcaagaaaaaagaaaaaaacaagaggaaagctggcaagaagccattgcaagaagcagcatgaagagagaagaaaacaagaaacaccaaagaaaagggacatggattctgatgttgctgctgctgtgtgttccactcccaaaggtgaaaagtttcggataccagaagtttcaacatgccctccagcaccaaagaagaatccaagggtgctttctgattgctctttgcgtagatcacccttaccattctatgcaccaccagacatagagaccttcttctgctttgcgcttcaagatcttcccgtttcatttgtttgctaatatatatatatatatatatatatatatatatatatatatatatatataagtagacgatctcgtgaaactttagaacatgcatggacttttcttatgtacttttagttttttctacatctcttgcaaatgagaggtatatgctttgagagaaccttggaggattttggagtgattgatcttaggaacagttattcaccctatctttctgctaactttaggagggtaacaacttgtaggatttgtctctctctaaatttagctaggggtacgtgtgctctcctaattagatatagattttaagtttattttcttttttctctgttatatatagaagatatattttctgaccttaatttgaagggtgctgtgatgagtgcaaagaatattggttttggttgtagatttgagcgtcatagcttggaattctacaaaacaaaacatagtttagtcaagtggttgctctgagagaaattaaagtccatcatattatcatatatatatatatacttcctttctgttcaatttcatcttttattttatttcttctactaatttcttctgcacaactgatgatggttataagtttgatatttagttagtagctacgtaccttttgtctttaaaaaacttgtgtgggtagatgacccttccatttataacgataaaaggattttcgatcgttggcaaaattaatcttatcaaattaaagagttaaaatatagttataaattctttaaaatattcaggtgatcagatgccaataaacgaattgatataatatgggagaaaaataattaatatatttaattttataaaatgaaacatattttgagacaaaccaaaatataatgagatgagatggagaaattattttgttatgtattgattgtattttgacacatctaggctgtatttttaggagtttaattccgggcaataatttgtaattagtatttttttattcataagttgtaattggtatgcctaaatcccactaataagtgtgtgtattttggtttttggtttttcaaacaaaaaatgaaataaaagtgaaatgttattttaaaaatctgaaataattttgtcagatgtgtgactgtactatacgtgtctctgagttcggccccacagtctatgagaatccaatgaaggggtctctcttattagagaatgagaatctcaagaaatttctcatatttttgcttttattttatgttgctaaatgctacttgctctactcgcttgtcgctactcatacgggaatttatttttctgtgataaaataagagtagtggaattgatgatctatacttatatagtgtccctcaaatgttactatttttttttttttttgctacttggtttataatcattatttgtagcaatagccttgcgtgtgtaaatgtacacatgcacacagatagatactttggaattaaggttttaaattacgattgcacgtagtttcgtcgttttttttatattgtaaaaaattaaagataaatatatatataactacggttacaaatacttcaaaaatcttaacaaagtaaaattaaaaattagagtcgtagaatattttctaaaaccttattcggagtaaaggaatagaagaaatgaattgaatgttgtgtgtggtgtgccatatgtgatatgtggtaatatttttgtacatgtataaagaaataattaaggaatatccttgaataaggatgtatgattctttccaaggatctatttgtgtgggggtagttgtacttagaatttttttaactttttaaatttatttatatggatctaccatctcttaaaatgggcctaaaagatgtacatattatagaggccagaatccatactttccgacctatcgaattaattatgtgtaaatttaaatacaatatagaaactaacaaaatttggcatatagttgacagacaataagttttttaagcatacggattatgatttaattttcttactatatatatgaaaaatattttgttgaaaatagttatatccacgttagtaatttctcaactttgaaagagattaatttccaatgtatcaaatgaaaaattcctttgatgtacaaaataaattttaatatatatatttttcatttatagaaatcaaatttaaacaccaaaaaataaaacaactcaacagagtaaaatgaattgtgctagatgctcttagtttaaaaatatgtttaagtaatcatataacatataagtaactttagattattatttttaaaagtaactctatcactgataaaatataaatatgtcttataccttcgtaattcatcatgcagagacatggagcttatatgccagttcgccactactatttgcgttttttactttttagtgtaaaataaagtgactaaatgggaagcaaaagtgcaacctgaacacgcgctattgcgaaaaggtagcatgtaattattttgtgttgaaaaaatataattgaaattgccaatagtgcctgcaagtagtacatggggtacacaatagaaggttctagcgtctatgtagtgtatatgttggacatgtcactcgttcaactagtgtgtctaacataaatattttttaagatttttgggttagtttggtacgagaaaaaatgagagaaaaaaataaaaaataaaaaaaatgattaatgaaataatttttttgtttatttaaaaaaatgaaaaaaaaatatttttaaatacaaaaatttaaattttttcttccctcactttttttctaattcaaattttaattttttttcttttttatttttcttccatccaacccaacataggattaggttaatattttttaaaaaaaataaaaatgcttacatgtcatgaaaaaaaactactttgactggcatgctatttaaatctatagtcaaaacaaatcccctatggttaatattcgaaaataatcctatattcgtcggtagtttctaaaaatgttccaatttagtcaattaacccctaaagtagtgatatttttggaagctaattatcataataggatgctctaaaaccttaccaaatttgattattttaacattgatcaggttaacttgtcagttaaacaagtgggttccaaaccacatcaacatttttatttttttttaaatattttttattgagaatccacatgacacatcatgtccaaaaaaacttcacgatcataagcaaaattcaaaatccaaaagaaaaaacaacatcgagttcactacatatatatcatgtgtctagacacacaaagatgacattactaccaactaaaaaaataggtatctttgacacatggcaacatctagataaacctgctattttatttacgacgtgtctacatctacataacgacatcataaacaaaatccaaaatccaaaaatattgaacttcaacccaagacacataacaacacccagcaaaatatgccaataataacaataatttcttgataattccgtatagtattgatattatatatatggacgaacagcgggttcaatgcatgtatgttatgtgtctagacacattaaggtcgcgaaaataaaaataaaaagagtgactttgacacatggtaacaactagacaaacttggtagtatgcttacaacatgaataactaaccgttgttgttggcaataataataatagcaataatatataataataataataataataccttgtagaccattaaaaggattcattatagaaagccactaaacattagctaattgttgactatttgatatgtgaccaaagcgtaacttttatttattaattagtatattttcttctcacaaataatactaaatacgtataacaactcatcgcacattagtgttaataaaatataaatatttatttaagaatacaatcgaaattatttaaataatgcttgatttcaataacttccatttacttaaattatttgttatattttaaattattcaaaacattctttataaacttaaataatataaaatctataattttttacaatataattataaaataattaaattattatataatttcacttttaaatttgaaacacatttaaatttatagagtaaattcattactttcttctgattttataccagaaagaaaactactttcttgtgatcttccacgtggatggatatcgtccgaactgaattagacccaacaaagtaaacaaacattgaaccaaacatgattaaaaggtaaattcttactttatagcaaagttattaaaatcggatcgaaccagccagtcctactggttggatcgggaatcagtaacataaccgatttgattatactattaaatcagtcatgcagttgacttggtcaaactcgatcaaaatcagccaaatcagacaaatcggatggttttcaaaacccgggtttgaaaacgcacaccagaaaatgaatatggcacaacagaaaaacaaaaggaagagaaagaggaagaggagaggtgatgaacatagaggagaggaagaggtgtgcagcacatgaaaatggaagcgcgtagcagccacgcaaatgaaattggagaagcagcgacagctactcaacacctatattattaggattaggttatagctttggccttcatttgcttttttatcccttttattaatttctatagtccttttgactcattttttattaaaaattgggtttgtattttaatttaattagttattatttatactctattttattattaatacactttacttatattaacaattttaatatttcaattgatattttgaatttttgaatatattttttaatcaaataatattagttatatatttatatataatataattttaaaatttttaatatagaccgattcaaaccggtttaattattgacccatcagttgaaccactaaatcactgatccattatcttaaccgattcaatgatgaaatcggtttttacaataagtatagtaaataaaataaaaggcaaatacttttaaaataattaagaaaaatagacgaagcccttaaattactccgagaaaaagaagaaaaaaacgacaacaacttaaaaaagtggtgccacgttttgcaagagatctcaatttgtttaatttagaagtgactaataaaataataaattgaattgtttatgggctgtgacgtgataataggtgtcccctcagtcctcactggcaggtaaggctcacctttcccccttttttaaagtaaagaaaatagagttaattatatggtggagaatcaattattaatccgaggaaactaaaaaaaaagatgtttacaaaggaaaatggacacgtgcctcacattgctgtcaattctcggaggctatggtccccacccttaggccacgcgtccaccggattctgctagtcaagtgcctgtcacgtggcccataaattgtgttcctttttccttctcaggggctctgatatcctcacccaccctccccctctcagatacccttttccctcccatttctctccacgtgtctcctccgtgaaacttgatgctgacgtcatcataagatgtcacttgaaatttaaacaggcaaggcaacactggactacatttgctattgttgttaagatttttttactttttattttttattttcactttgactcgtgaatgaattcctttatcctcatatatcacaactgaagtgagatatcaacattcagcaccccaaattctagttatagagaaagcaaagttctttgatttgccttcctacccccttaatttcctttattaatcaattgggaaatttggtctaattgtgattcattctctttgggggattttgaggattagggttagtattttctgtgtctgcatgtgtgaattctggcaagatatcacccaaaccttattttttttctatgacatgtgatgtgtgaatgttttctggtagcaaatgtgggagaattgggattttggtgcatgtactaggatcagataaactccaaattttggtgattttctattaaatgtagctcactagctagtgtgtatctgcttatgtgaacactagctatggttgcatgttggaatatcagtatatcacctggggctgtttggttgtgtgcctaaatatatggcagaaacaactgttgctgattatgattttgttcttctaggggcatttggttgctgggcactgaccaagagttgaaagattttatatttaccttcaaacagctgcggctcctgctgaagatcaagtaagagcaaaatggaaactatttttgttttaagcctctgtttgcttaacaagtattatatcatttcatgatgaattttaataattttgaatttgggtttctcaattttctttaagttgcacatgtcttataacttcacacatatgaggctatgaaactttttaatgtggctttactatcaatcagcatgctgcattttaagagcctttcattaatgaagctatgaacaagcagtagcactattgtaactttctgtgagttgtgcttgatatcatattgatcaatttgtacctctagaagatttggacatcaacgttcctgagacaattatggctatagttttcacttcacgtgattttgtttcagaaataccttgtttatccatttttttaattccattggagggtctcttattgtaaaggggaataaccactgtcattatcaacttttatttatcttgccttttgttttagcataaggaataaaatttgtaatccaatattcatttgtagggaactagggttctgaagataagatatgcaatccaaatctgaaactgcaaatcaactgaggtctgatccacattcctttacacctaaccatgcttattctgaaccctggtggcgaggtattcagtgcaatcctgtcccccaagcaatgtcaggagtgaatgcttctaattcatcttcacttgaacgccctaatggtgattcagaatccagtgaagaagatgatgatgccactaaagaaccacaacccactgctcctaatcaatcaggtgctttagattgattgtaaagaaaaatataagcattaaaataagaaaagaaaaaatttgcttatatatagtggcccaaattatgttcatttgattttttttattttagtccaagtgttacaaggttacgaggatattgaaatacaatattcttttcttggaaggaaattatggacaagaccaccaagcgatgcaacattcttcatcatctgcacctttggtgcgtgatgattgccttacacaggctccacaactggaacttgttggccactcaattgtaagactttgcccttttgttattttttatttttattttttagcatgaagagagggtgcaaagatcatagctttatgactatgtttaatagaataaatgtttgctgatttctgcatgtcaatgatgaaaattcaattattggaaaaattattgtcaaatcttgcatgcttttctaatggatcctagtatgcttcaaattcttttactacaggcatgtgcttcaaatccttattacgggggtatgatggtagcacatgtgcaccaacagttggcatgtgagactaaccagtgctcatacaattttttttttttacatgtagtttgtcaaactcactgttttgcatttcccataaatcaatctggttagaaatgtagtttgtgcataaccctgaaggatagattcttattacatgataattttgtttcatgctatttgttttttttttttttttcctgtttcaaacaatggtgacattgggatatcactgcaatggtataacatattatattttcactattagggatacgctccttttataggaatgcctcatgccagaatggctttgccccttgagatggctcaagagcctgtttatgtgaatgccaaacaataccaaggaattctgagacgaagacaggctcgtgctaaagcagagcttgaaaagaaattaataaaagtcagaaaggtacaaatgtgcactagcttatgcttctgtaggcatgattgttactctatagttctgtagttaattgccttaatctattttggaaagtgatatctcaacacatttcaggtttgggatatttgtcaacttattttattttacattgttctacaaccaatttcctttctgcagagctaaaactttagtttgacatgaaggagttttaactgtgtttatatctacacaggataccaaagtaagataattggaaatctagtaacctctgaaccgttgaacttttgaaaatcagtagaagattttaacaagagtgctgctttacctaaatgtgaaatgctatggatcttgaaagactcaataaattaagaagaataagatgttatcttcatttaggtttacacaaacatgtgtcaaaaatcaaaatttgtttttaatgagacaggttggcttctagtataatactgtgtacttcatattttgtacatgcaaatctgcgatccttgggcatactatactaacttctatttcttcacagccttatcttcatgaatcccggcatcagcatgctataagaagagcacgaggtaatggagggcgttttgcaaagaaaactgaagttaaggcttcaaaccacatgaacaaggaaaaggatatgggtactggccaagtcccattgtcacgttcaattagttcatctggttttggatcactgccctctgattctgccgagacctggaattcgcctagtgtgcaacaagatgcaagaggatctcaagtgcatgagagatttgaagaacacaactatgcaaatgttttgcagtcatcatctactttttgtttgcactcaggtgaaagagcggaggaaggggactgttcaggtcaacaacggggaagcatctcgtcggagcacacctcacagaggcgtcttgccattcagtaaaccattgcatggagtttgatgctgagattggtatataattagtggagtagtaggttgagtctgtaaacattggcaatttgcatgtcaagcggcaaatcattcttggctgtgtttctgctgttcatgatatggggagaagaatgattgattggaccatcatatttgtgtcgttgaaatcaaccagtccttcattatattctcttttgcattttgtacaaagatagtagtgagctaagtcaagccaacgaatcagaagacttgatgaaaagaactctttgatctactgactcactttcctatggcggctttattttatgtaactcaccggttattaatgttaaatatgagacattataagagatttgctgcatgattgtattcgcatcttcttaggcttttgacattttttttaccttgcttttgtgtgtcatcaggtcattagttcgactgaagtttgaatgtttgatctcatctagttaacgaaacttgcagtaactgttgggtaaatcaaaaacagaatgcttcacgtttcttgaaatactccaattttgtcatgctctgaatggaaatgcaaagaacatggatgttttgcagtttaacaataaattttaacaaagggaatagattgtttagtacattaaatactgtattttttacaatagggaatcccatccaaagctaagatcgagttccaccaaagttactgaagtaaaaggtcaacaacattgcagggtcacttgtgaggagcttctaattataccaagcttggcttaatctaaatattatcgataagacttaaaacaaaaaatcaattagagctgaaaatttccccacgaaatagaaaaaaagtccactttcaatttgtttgtataacatagtggaagaagaaccgaggaagtagaaatgttgagtttgagttcattcattcagtagtggataccttccgcatgttaccaaatacagaaccaccagtcctattgaaaatatgagagaatctgcatgtttaatgtccaactggattcagtgcagtctcctattccttgcatttgcaaccgttcaataaagatcgtgtcttcatctaatggttccaagttactaactgagtgaatgtgtggaaaggccattgcaacgattaaaatggaagaaaaaataaagtaggctatctgagtctaattccttggagaggtctcaaagcttctcagcctattttttcagttactattcctttaatacatccagtaagagtgaacaatccaaataaaaagccaaaaatgctgaaagtccgaagcagtacccacttactcgtccatgatacagtactggactgactcaagtatatttccaccggaaaatatatggtcaatggccaaaaaatgatgctacccagaacccccaaaatctgattgaagtagggaaatatgattgcaatcacagttgttgatgcaacataagcagttcggaaagacaggctgagaaaattaagttcaaaggctggaagcaacgggagtttcaacatatatatgtgattcacaaattcactatctgggaatctaaaacggaaccaattctcaacagtggcaaaaagtggctggctatacacctgcaccaaaacaagttagatgacacttaaatgaacatgcattctaatttctataatgtaaaatagtacagacaagtagactatatgatgatttcataacacactaccctaagacaggtgatggagaatataggaattgaagagatatcaaatgggagcaccatactaagaattattgacatggtatctctatatttatatgtacctgatatgaaccaactaggtgaaccactatacaagcattagcaaagttcacaagccaataagacttggatgatccaaaacccgttaaaaggtttcctggtgtattatcaccaaaggcagcatatccagcacctccacaactgaggtacacgaatgttgtgacggtgaccgctattactgaggcctttttcatggtttggttttctggtggaggcgatttcaaagtatccttcaaggattgcagtagattatatcagtctttataattgttaaaatccccccacccccccgagctgtggtcaagttacattctggttatctgagttcacggggtatgtacctgtatttccataagaattgttgagaacggatatgagaatgatatgtcaccaagtgcttgagaaaccagccataacttttcagctccactggaggtactaattcctccaatgctaccctcagcatgtcctttttctgagcaattttttttcataaaattatattttctacataataattagtccaatatatatttttcaagcaaacgtccatgcacaagccagtcattgtgagcctaagcaaagactcgccatacgcatacctatgatttgagcaatggaaagccccagtcctatgaaagaataagtaaaggacataattgcagcaacaaccgacagccatttgatgttatggaagttgggtatctgtgagagaacaatttggatagccccaaaaagcagcatataatatgcatctacagattcacatgctgcttcaggcccttcgttgtggtaacaaaatgaattttggattgttctgcagccacaaataaaaatagcagttcaaatttaatattggcaacatagggtgagattcttgggatagacacatgcttccttagtggagtaccagtgtaaaaatcttgttttgcacaaacggatgaaaagaagaacaaagaaaaggaaatgacagaacaggagaggaagcagtatgataagtgatgaatcaacacaccttaagctgatagctgttgtgatgacgaaggcaattgcaaaaccatacagacttatattcacaagaaggccactgagccgtccattgcttaatcctgttaccaccgaaagaggatcttatcttataaaataacattctagcctatagaaccatatcaaatgttccaaatgaggtaattggaaggagtataatcgatcgttcatctggagacactcataagattttttcaatacacaagagtcgatgttaaattgtagaagaaaagaaagggaattgtaccttgtacgtacctaaatgcaaatgaacaacatcaaggtaggaggcactcctattgggaccatattcgggatggggatggcgataagtgttgcatagaagaaaagaagagaagagagtggtggaagcaatgagaaggatgcagaatgggcctaaaagccacccaagctgtgcagtgctccatggcagagacagcactcccgatcctatcaccccagtcactatgtgtgccactgctgtccacaccgtcccttcatcacattcacaacacacaccaccatgttacttagttatactatactataatctattcacttttgcacaaaacaaaacattttagatgacaacacaacacaaacctgtccttttgagagattgggtgagtaacagtgggaggttgtcatttgactcagtctgagctgacacacccatcttcacaccaatatcagatcagatgctatgtcatctttgccacttccattcctgtgaccttaaataaaagccacacagggagaaaatgggaagacacaatttggatttttctcctgttgttgttacagccatgatgggcaaaaatgtcaaaagcccatgtgggaaaaagaaggaaggattaccaagagtgtaatgccaaaagctgctactagtcagcgaaataaaataacttccgttttttttttttcttgacaaacgcgccgactagtatcataagaatattaaaaagttaaaagaaaataaatgtttttattagaaaaaatagtattttttatgatttatacaataaatatttttttcttttagtacgttgataatgtcttaataaatcggactttatttatttatttatttagtttaattatttttttcatttattttatagaagatagtcttcgcacactcgcactctgagacagtcttaagtgtatgttgttggtttgggctgcatgcatcgttgtttgacaaattacgtaagatagtactgcacattagaccttagtacaatacacataaccccaaaaaacaatttaggatttaaagtgtgtttttaaatttattttttattttttattttttgaaaatactatttttcataattaaaaatatactaaaaatgtttgataaataaaatagaataaaacaaaaggaatataattaatttttgttttatgttttctacatattagtatatgatccataaatgacattttttattttaaaaaataaaatcaaagatcaaccataaaatatagatccgtgtggtaaacgcaacaataaaatatatttccgtgtgataaacgcaactataaaatagaacgagactaaatgattaaaacaataatatattttaagatgataaacgcaaccataaaatatcgaaaacaaccttctatagccggtccaagatatggtccataatggatcatatgtttcactggtccaccgaagttttgccctgtaaaccactctcgtatatggaaaaataaggggtgactgaaaatgagatgcacctttttgaaataactggagtgctgggaacaataaatggttgattagatttctgttaagactgcctcttaaacaaaatcaagtaagaatccatcaataacttttgtaaacaatgtttaggacaaactacctcaagtcagcaatcttacattcttagaatgtcctattctaacaacatagccaataacatgccatcaggaacagatccatttcaagtcatcaaagagcagttatcattctctttatctcagcagatctgctgggatccggttcttcaattgttctctcggtaagtacttgcttgatgcggcacattgactttctcacctgatttcacaaattaaattgacagaattactgattaatttccttatttatcacatcaaattaatatcaatttcagaatattagtttctaataaaatcgattctcccataatacattcttgaagaggaacagaaagtgtgactaagtcccaaccaaaaattagttccattaccgattcaaaggaccaaaacttgtgggaatatcttaactggagtcaaagaccctaattaggatgacaaaaaaaaaaagaatactagtttgtattctctctgcttccttccctacctaaatccctataatctcaacactatctattatagaagttaaacatgcaacattcaaattctctctaatcaaatctatacaaaacattgttcatgaaaataagataaaagcaccacttctgtgatttttctatgccaaacgtagacataactaagggtaagaaaaggccaagagcaacatttatgtaacacagaacaagggaaaagaagtgaagtaataccttggggatgcgctcaggttaggaaaacgcaggctctgtgcattaagtatctgacgttgagtcatcaacatgttcttctcctttaacaacacacaccacaacttatgaaggtcttcccaagattttagacgcaattccgatgccttccaactccgacctaacaacaaatagataaaaaagtaaacaaattcataaccagagcaaaaaaacggcacaactttcaaaggtcaatgaagaaaatcagaaatatttgtactagacaagtctgatcataatgaaaatcagagaaaaattgtcatcccaaatccaaatgaacaaaagaggtgcctagtgcataccatatacaacaggtttgtcatcgtcagggctcctgtctgcctcaaagaactctccttgctaccaacagcagctgtagtggcataaggttttgatctggcagcagcagcggcaaagagtgtttgtccaattctgctctgtattttgacatataccagtattttttgacagacaaacttagctattgaaaaaacaaaaaacaaaacaacaagagccaaaccagtatccataatatcacatagaaaccaattccattgcattaatcatcaaagttcaaaataagtcgaactaatcaatctatatattatgaagaagtaaatataaatgagaaaatgattacaataaatctctagttatatctacatagtcatctattctaatttgaaatgaagaattgatttgttgtatgcgattcaagctgtcaccgtagtatctatgcctttgtggtgcagtaagagttaggggagcttcctccttaaataagcctataagaggacacaactaaataaggttagcaaacaaattgacagaatttcaatgctaaaaattacaaaataattgaaaaacgtatacttgcacaaagtaaaaatcgtgaacctatccaatagcaatgattcaattatgtgcaatagttaagggttgactactaagtgggaaaaaaatgcaaacttggataaagtggaccaacaaaacatcttacctattaataataacacaatccatgtcaagaatagatatccaattatcaaaacttgctacttattattttaaacatacaaataggagattgcttccaccttgttttgagccaaagagttgagcatattcaatatgtcatcgctaaagttcccaaatcctatcatcacgaactagaatccaataatcctcacccttacctaacaaagctgccattgctcaataattgccataaacatcaaacaaaaattcaacattaagacaaaaattgtgtcacgtcatcttcttttatttccacgaatattaaggtaataatcaatattttcatgtttgttaagagattatgataatatattttcagatataagttattctcaagaaagttatactcataagttttaaacattttctattcctacaaggtgttagagataaatatgtatgtccaagatacaattcatcatgtcattaattttaataaaaaattgttctttatttattatatttattattttattaaattgttaatttgagaagtctttgattaaaattagaaagttgttatcatgatagagattatgataatgagaaataagtctttataattttaatctaaattattttttaatataggattattgtgaatatgatatatataatctagatagatcaatatacgtgtaatggtctttattggataaagattaatatatctcatttattaaattgcatatatagataatgtacatgtgaatgtcatcattgaactgattcaattaaaaaattttaatagttaatattaccttgatatgtcaataggaagttctcaataagaaatataataatttttttacatgagattatcatagtaattaacaagttatttatgttgttttaattttgaacacctaatgccttatgacactagttgatgaatagttgaatgaatattggatatgattaaatatttgtagaattaatgattaattaaaaaggaatccataaactttaggtaataattgagctctataatagaattaagaccttggttaggacaattggaggaaaaaagaaaagagtttcttaggtcattcgttaattagatgtgttagcttattaaagtttgacaataataatatactctaaagttaaccttagatgtaaatgatggaagtaaatattacattaattattcttctattggttcttgaaagtaaaagactttaagggtgttgatagatgtctaccttgattagtaaattaattatgattaaattactatcgatttaacattgaaacagggtcacgcacaaatgaaatgaatgtttcaatctttgtaaaagaaaataatttatttgataattaaattagagaatttaatcaaataaatattctagtgaaatattattttattatataattaatataaaaaagagtattattttataaatgtgaaagttgttcataaaataaaaataatattttattgcttattaaattagatatatgagataacttttatttttataaaaaataaagagatataatttttttttctccctttgaaaaggcccaactccataactttttaacattataaacagaagtatttactacaccagaaaaaattaaaaaagttcaagttagttttttttagtgagaaacagaaagaaaatttatttttcagagtttcactcattatagaattgaaaaaattaaaaaaattaaaatctaattttttatgtgagaagtagaaagaaagttagaaagttagaaactttattgttcgaaatttcactcatcaaaaaattgataatagatattaatttacttaattgaagaaaatttttgttatttcaaaaatgtaaataatataaataaacaaatctatttttttctatttattatgtgttatatatattttgaatacaaaataaatcctaattttactctccaaactatcaataagatgaggacatttgaatcgaaacccatttgtaataggctactaatcttttaaagttttaactgtattataaaggtaagaaacctagcctttctttgcctcctctgactgtcttctaccggccaccgcaaacaaccaccgacctccgttctactggtagagtagtggtggtcgattgacaatatatattgattcagatgtaatgtaatgtaagacgttggggtccttttgtttcatgctaaatacagaaccataatctcttgtttcttcttcttcagcttccattttggttcaacgagcaagcgcttgtcgttgtttccctaagcatggcgcataggttgctcagagatcacgaagccgacggttgggaacgctccgacttccccatcatctgcgaatcctgcctcggcgacagcccctatgttcgaatggtctgtttcggatcctcttcgtttgttaggttttttttttttctcttttgttcttgcgagattgaatgagttattattggaatattaatagttatagtgataataaaaataatgattgtttagtgaggaattaaaggttgaaggaacaactaaactgagtcagattttaatgtgtggaacctcgtcatgtgaccagctactaagaatagaagagttaatttgttcaatagctttggtttgcgctttgcagtatttttatcctgagaatgagaaatttctagatggcaactgctaagtttaaaaccttttatgttattcaggcaggccaatggttttgttttcaaatgtctgaacttggattcctggagcatcttagcttaattcttctagggcttttcaaatgaaagagcttaattatttcaatttttttcatctttgaagtatcgaacagtaagttttttttttatcacagagtagttaatgttgaaatttaaaatggtatagttgatttactggtgtactatgaaaaactatggagtcgagggagtccgtgaatgtgcttagttaataattttcagatttcagcatcttccattaaagatgagattgtgggaatccaattatttgttcaattgcttttcattatgcttatctttcggtgcagacaagagcagagtatgacaaggagtgcaagatttgtacacggccattcactgtttttagatggagacctggtcgagatgcaagatataagaaaactgagatctgtcagacatgtagtaaattgaaaaatgtctgtcaagtgtgccttctggatcttgagtatggactaccagttcaagtccgagacacagctctcagtattgattcccatgatgccattccaaagagtgatgttaatcgggagtattttgctgaagagcatgaccgtagggtatgtttttcttatgctaagtcatgtttatagtttatgatagctgaacataattaatgattggaaaactagttatgggtttaaagtcattctgtatgtagtcatgagtgaattgttatttttgtggcttgcatggtttttgtaatattttggagtttttttttttttttacatgaagaatttctcaaccctggaactctgattttcacattctaaattgacaatagctattaaaatttcaaattttctttatccatttttttaagaatctataagactactattttgactcagttctctttggtcattacttgatcgtgatctttttactaagaataaaagcatggtgcaggctagagctggtatagattatgaatcctcttatggtaaagtacgcccaaatgatactatcatgaagcttcaaagaacaacaccatactacaaaagaaaccgggcacatatttgcagtttctacattaggggtgagtgtaccagaggagctgagtgcccttatagacatgagatgccagaaactggggaattgtctcaacaaaatattaaagatcgttattatgggtatgtatggttaaaaatgacttccttatttgcttttgacttttcttactcgatctctctttcaattgctcttttttagttttttaatgtattggcatttggcactgggcagcaactcaagcattttttatctctgtgatggatatagttgttggtttattaggcactcagttcttttgtggttgttctgtgtgacgaactattgtgtagctaagataataagcttgcaggtttttttttcccagcaaagtcatgtgatagttctgcttgtaggaagctttgttttaaacaacaataatcaagccttgttccaccaagtggggtcagatatacaagtcaaaaccactatttgacattaacatttggggatccaaagtggcaaaattttattgcttactaagttttcttaattgttggtacaaaaaaaaagcagctgattcagtagcacgggctacaataagagctcggtgtcattatgttaataaaaagtggctaataactgccatttacttgcaattttggctttcttttttttccttctatatgtggctaaactgaagtcatgtattgtattgttctcagtatttagtgaagtggaatggcttatcttgcctgcattgtccttagcctgtaatttttcgtacttttaagaatgttttctttgtactttgctacttgtcgatatgtagtaagagaattttttgacatggatgaaggttgattcctttataatatgttacgtttaattttccattgtggccaaaaatgatgtagcagacagtcaacagccatcaaatatcttattgtgaggataaccttttggttctatattttagtgctatatgtgtataaagattattccttttcaatctcattaacgtatcctctacttattcttagttttctctgcatgaattccttgtgactacagatactgatgatatttctagttgcagtagttggtgtttttaattttgcttcatggttttgacttcattagtttgctgttcatgctttaaaacgttcagggtgaatgatccagtggccttgaagctacttggtaaggcgggggaaatgaacactctggaggctcctgaagatgagaacattaaaactctctatgtaggtggacttgatgctagggtcactgagcaggatttgcgggatcacttctatgcgcacggagaaatcgaatccatcaaaatggttctccaacgggcttgtgcttttgtaacatatacaaccagagaaggtgcagaaaaggcagcagaagaactctccaacaaactggtcattaagggccttaggctaaagctgatgtggggcaggcctcagacatcgaaacctgagtcagatggctctgatcaagcaaggcagcaggcttctgtggctcatagtggattgttgcctcgggcagtgatatcacagcagcagaatcaggaccaaatacaaggaatggtttactataacaatccaccaggaccaccacctcttcagcaggaaagaagctactacccatctatggatcctcaaagaatgggtgctcttgttgcatctcaagatggtcctcctggtgggccttctgggtcaggggagaacaagcctagtttggagaagcagcaaatgcaaaattatacccatccaatgatgccacctccgcctggccaatatcatcatcagtattatcctccatatggttatatgccaccagttcccccttatcaacagtacccatcttcatacaatgctgcagtggctccatcccagccaccagctgcaaatcatgcttatcagcattctatgcagccagggtcttcacagacagggtctggacaggctgcacatgccccagctgaatctggaacctcaacatcaggatcgcagcagcattaaacttgcccatatactgatgtttctagctatgtttaagtttttccttaaactaactatgctgtcatggaagatattttcactcaagttgtcaatttactatctctactagctcgatattgatttcctcgtggcttgaacaagttattttataatttgattttgtgattttgaaactcttggcttcctggttaaatcatagtcatgctcagctttagtactacttaatgaattctaatgatactacaactgaacttttgttttggatataaagcatttagtaaagatggccaattgattttataccgaccaataattcgtgaagaatgtagattgttttagaactctctattgccgagggttgtgttttttctttattttgaaaagcttccattggttctttctttcttttctctttttggttatagtacgctcgtgtataattcttgaagagtgtagattgtttcagaactctctattgccgagggttgtgttttttctttattttgaaaagcttccattggttctttctttcttttctctttttggttatagtacgctcgtgtgggcactcttttgttaatcttaatgataaagtaatatatgaatgattaagataacgagggcctttcattcctaaactgtgcatttgcatctgacattttgacattcatctttctgtatacccttattaatggatttctatagtgatttttgatgcctttcaacatgtttttttaataaaaaaaatatttattcatttcttaaccaatacattaggacactagttatttgggatgactttatattatgtcaatgtaaaacaaagttatgtgacattgcacaaattttgagctaaatctaataatccagtatcaattcaagtttatgtgtatagagttgtttgtgtagcatacactttctttaaagggagtttttcaccaaacagaactattccacgtccacaccaccaccactttgagacatccccacataattggtatcccctttattaactctcaatagtaaatagtaatagaattaatgtgaaactgaattacatggaagatatggcaacaagacaataaactcaaacaaatgaagcacccttcattatcttagtttctcacttattattccttcaagtgatccaatgagacccactaatgacaccagaaagcaaataaagctgaaggtcctaaggacaatccattttctagaccaagcttcaattttcctctgcacaaagtacatctctaccgggaaatatatagccaatggccaaaagcctaaggctcctaacactcctataacttgattgaagtaaggaaataggatagcaagtccagtcgtggaaaccacataggctgttctaaaacatatcctgaaaatgtttagctgaaaagctggcaaccgaggcagtttcaattggtagaaattattcacaaatccactgttggggtatctttttgaacaccatctgtcaacagcaccatatatcggctgactgtaaatctgatcaaaagatcataaacaagaatcacaactatgatttgtctggtaacatgaaaagaattcagatattgttgcatatggacaagaattcatatagcttaatatttattattttattttttctaataaatgtcattggagcatttcataagctaagttaggaagctaactatttccagccaaacctttcctaataatgtattaatttagaacttctcttgtattagttgttttaatttcttccttatggtaactttacctgttacaattgtgctttcggtatgaataccatcatttctattaattttacattaagaaagaatgtagtagttcaattgattaataagaagttacagtcttaagtataaaatgtgaactttgatcagtagcactagtacctgatatcctccaaccaagtgaagaacaatgcaagcattcgcaaagtcaatgagccagtaaggctcgtaaaatccaaaccctgtcaagaggttccctggtgtttgatttccaaaagctgcatatccaaagcatccgcaacagaggtagaagaatgttgtaatgaggatagcaatcatggaggcctttttcatggtcttgttttctggtggaggagactctagagtgtccttcagtataaaaaaaaaaaaaaatcaatacttagcttcagctgtaaattgtgtcttcttttagagtttaatttctataaactgataatgaaaaaaaaaaaatgcaccgtcaactgataaaaaatcatgttaaatacaatttttaaaatagctattataacgtaaacaaacttactataaataacaatttgttattgaatcacaatataaaatatctttacagtttacttgtgagtgcatttaaattaaattctcctttacacgttcctctcccacccaattggaatatgaagggtacctgtatctcaaggaggatgactgtgtatggataggcaaaggcaatatcaccaattgcttggaagactaaccataacttgtcagcaatatttgaagccggtactcctgttaaactacccataattcttccattttctgcaaaagcaaccaaaagtctcatgatccattgttctctttccactccttgattctaagaaaatatcataatatagtttttttcttcatacataaattccacattccatatattttggcatttaatatgtttttagcagctacatttgtgttttagaataatagtacttgtttttttttccttcatcttgtttcttcaatgatcagaaggcttgaacggacaagtaaacaaaacattaaattctaattgtgaaaatgaaccttacctatgactgttgtgattccaagtccaagcccaatagatgagtatgtaaaggacattatagccgcaacaattgaaacccatgccatgttgtggagatctggtatgaatgacattatgacctgaactagtccaaacagcatcatatatactgcatccccatatttgcaaggagcctgatgcccttccttgtgataacaatttgatttcaatatcgctctgcattttgtagaaagaccaagcatcgttagaacatgaacacaaatatcattaaggtagactagtacctctaatattacatgagataaaaaaaaagcaacagatgatacaagtaacaaactactacacaaattcaaaattgcatatatacaatgatcttttcattttacatgggatttaacgggaattgtacctcaaacaggttgctgtggtaattacataagcagtactaaccccatacaagctcaaatattgaagggaaccagccaaccatgtccttttattgcctaaactaacagaaaacataattagttggcataaaatatggtagcatttcactggaaccatatcctgaatttgagactagagtgcttgtacaagaacaaggaactaccaagatagactctaacagcatccatgtaagagtagtttcttttcccagttacaggatccagagttctgtaacaatcggaaaggaggaatgaagaaacataggtgacaattgcacaaaaaagcaagcaaactggtcctgcaatccatcccaattgggaagtactccaagctaaagacagaacaccagcaccaataatggctgtgatgatatgagccacagcactccataaagttcctggtaaaattgatggaaggactaaaattcaggagtcaaattcatatatatgaatatggaatggtcctagagatttttaccggtccttttagcacgtccatcatcgtcataaccaccactaccacttctagttatttggagagatttttgaacagccatttttatccaagcatccaactcaattggtattcatggagttcagtgtaattgaattccgtatacagtctacagccaactacaatcaaaggaactatatggcagctacttgaattcaaaattatgtttgtttggtaactacataattttggtctgcatgtcacatgcttatgaaattaaaaaaggagatgacattttatatgaattttcaaaattgataaaggactcttctttgatgtctaggacaactctcctaaaattaagtaattgacgagcagcatagaagaagttgcaggaaatagtgtaaataaatctaaactatgctgataaacatgtgtgtctgtgccaaaccaaaattaaaatagctagtatcttaaaacttttggaagccatgttcttgataactaaggtatgtactaaaacagacattactagcgacaggacacagcataaaatcaggaaaactttattgtactagatttcattataaaaaatacaggccagaacatgatgtgtagaggaaagagattctttgaagtttgaagctgtatggtgtatgactgtggtagccttttaataaagatatgtactcgtcatcataactttctaataatggagctgtcgtgttcttgtggaatatattctctcaatgctcaacattgtgaaaatgattcagtaatcagtatctatcagatgaccagaggtacgtgagtgaaatagtggggttaatgtaggaagattcagaatatttgaaaatgtacaaaatagataatttagaaaacttacatattatgtttaacatcatgttgggtattgctcaccttagtcaacacaccaaatactccaacatcatctctttctggtagtttgtgtacaaactttatatacatcacaatacttcataccccaacctactacatattattagattgtttaagaccaccacatattcatagtctcctctaatttttaaacgtcacgtattcaaaattttcaatttatgaaaaataattaataatatttttttacatacatgtcacgtggagattaattaatgaaatgataatagtttttatccacctaataatttctcacacccacccccctcaaaaagagagagataagagtttgtcaattttcgcttttttcactatgcctctcccgtacgagaaggactctattatttgacagtcttcaacaaactaagtgaatgaatatttgaaattatattggttttgtccttgaagttgaaagcacgccaaacgtggaagaccagagtgttttatgctcctattttcaacacttgcttatcatacctatagcccattacgtgtagcttctttctatccaaggagcgtatggaaaatattggatttcatgaagaatatgtaggactagaataggttgcgtaaaatgaatgtatactggcaacatggttcaacccttccttatcacacctaagggctaaggcccactaccgtttagcttctttcacttcaagctcaaggaacgaagagaaaatttgtgattccattgaaaaatatgtagaatcattttgcgtaaaagcaccatctttattcagttgagtaatgtcttttgctactttaattgattggaatatcatttggctcatccttatcgtaagcaaggattgtgctaattttatgggactttgtgaacttcccatatgcaaagataaagtatatatagtcttttttgtgcagcacccacaaaggttacaccttattgacgcccgcacacagaacataaatgaagtccagccaaaattgccacagcaaaaaaccaatgtcatacatttttacccagctaataaattatgcccttcaccaattgccaataaatgctgcacttccaccagcacttattgcaccccaccactggattagcaatgtgctaaaggaaagtagatatgaattcctgttaaaataactggttaggttaaatgcttggaaatctctaggtaaatatattttgcggttgcctctcagactcagatggaccacctattaatcatcaaataaaggaaagtatatacgtattttatgccaaaatgtctacctcgctgaaccagaatttctcataaactgtagcctatgtagcaggttggacctgtgtcttttaactcaataggaataacgtctgttcaaaataacatatatactctccttcaaaaaaataacgtctgttgaagcccctagtttcaaaagttgcaatttggttctgatactctgttgatttagtagtagaagtgccatctggtgggaaaatgcaaggatgtcatattaagggcatgtatgttttcactttttgattttaaaaatgttttgcaaaacaagttcacagttaaaaagtttttttcaaaacaatttcacattattcatatattaaattttcatttaaaatctattacattttaaaaattgttttaaaatacttaataaaacttttagttaccaaaagttattggtccaagtaattttagactcggtttctttaagtaaaatttcggatgcggaccttgtggataaaaaataattacggtacttcgtaagattcaatttgcataattgaaatttgattgatcaaaaatataattaattctaatcttcgatttttatcttgtttaatttttcctcatttactcattgtgtcttccagacttccactatcctctactctaccaactttttttaaattattttttgaaaaccaaaaatatattttagaaattagaaatcaaacactccccaaattcaacccctagtatgcgtgttgcgttcaattgtacaaaaaaagattatagaatgaattaagtttttttttttttttaatcttttggttctggtgttgtcagtggttattacttactacaataaggcccagtttagttataagagaataacaagagatttgaattttctacctcccatcttgaatcatgtatctcccaaatttttaaaaatcacaaactacccttttcatattaaacctttttagaataggtattttataacaataaaaaatagttatggcttctagaataggtatttcataatcgtaaaaaataatttttaaaatagatgtttcataacaataaaaaataatgttacataatagtcaaaaataatggttgaaaataaaaaatattttatatattttgaaaaccctattctagaactcaatctgtgtttcagaattatcattccgactattatataactttcgaaattgtgtctttggaataatagttgaaaataaaaaatattttaaaatggtcgttccagaagacaaaacaccatgtttcggattacattcttacctttaatgatgatgtgcaatggaaggagggaggggaaggacgttgtgcgacattgtgacttgtgaggaggagatcacaaagctgccgtgaagaaggtgaaattgtgggagaagaagttgtcatcacgggagtaattcacacagagagggaagtgttagggttggagaagggtaatttgatattttcaaacaaaaataggaggatgtaagatacactactggaagtgcatgattcaaattccgaacaacagtctgcatgtaaacttcaaattgggctaggccgagcaagtattatggctagcccagcccgttaacggtaacttagcaaaagcaaacgtacagttagagccatgtccgaagattttcgaaaaacaaatataagaattgacccaaaaaatattttgactgaaaaaataaaagaaaaaggaaaacaagcacaagaggatttaccaagtgtgtgctctgtttaatgttgagtaatgtaaaatcactttaaatattagttaacgtgattataggcaaattttctaatgttcagtccggtgttgaagaattgattataagtttataatttactgagttaaaacaatttagatagttttgcgttagataaagaaaaatactgaattttagtactaatttgcttttagagtaaagatttttaaacataaagaaataactttacttcacaatcaattacaatcaaaaccaattttaaaatcatttttattcaaattaaatcaattttataaatgcttaccatttcttattttcacgtttcaacgttgatttgattaacagatacattttttctattatttctcaacttttctatttgaaaaagaaactctaccaaattaatgcaccaggttatatttcccccataatttccttatctatattaatcttcatttataaataaataaatacaaataaaaaatgactaaataaatgtctactatatgcatctaaactctaaagtttatatcacataataaattttattttttaatgttgcaggcattttgtcaaactttgacattattttagctatatgaagttgataaactctggtgttttatggtaattcaagagaaatcaaaggtatccaaacccaaatatgtatattacactcatcctaactcaccattagatataagtagaacagaaaataaagctatgccaaattaaaaacacatgcatggggttacctgatgcagtgatgcaccatataagcccgcatgcaccagcactccacacaccttttgcctcgtgtctcctaatttatcatatcataatatttcctattaatcataaaagtggaaataagcatggcatatataatagtgtttgatcactaacctaggtagaccttaacagcatcgatgtaggaggggcacctaatgttgccatattgaggatgagggaatctgtagcagtcagaaagaaggtttgctgaaagaaaggttgttcctgcaaagaaccctaactgtgccacagaccatgctagagacagcacccctgcccctatcacaccacttattatatgtaccactgccctctctacattacctaattcatgtcacatgtataaagaataatatatagttagaattttaattacctttctttcttttgaatatttgaatggtaagcatgatatatatatatatatatatatatatatatataattaatgtcaattactatattcatctttaactttcatcacttggacataaaatttatgattaaaaaaatgtaacatggtaattaagaatattgatataaactccttcattaaaagtttgagaagtttttttttatcagttttattaaatatttttaattagttatacattttttaaataatacttgttacttaaatttctcaacaaacaccacactcattagaaaagacaaaggtgctaccaactgccattcacacaccagtcagtccaacaaatatctcactactgctattcaaattcaataccatctggctgcagagaaaattaatggcagaaattccaaggaggaagaagaaaagtaattccttttacatatacaaaagcattctgatgggagaaataaataaagctttcatattataaatgattaaaaacagatgtaataaccacttaccagttctcctaaatggcacgtcaagggaaggaaaagcttgaatcaatggagaatcatctgtttcttcctcactcatttttgtatcccttcaagcttgatcgatttgcttctcaaaaatcacacactcagggcccaagaattataatgaaaataattaaaagggtgtatgagtaagcatttttcgaaggcataacatatttatatatagacgcaagcaagcctctcaaataaacttcattcgaagatccacgagacacctaacccatgtttctgacctttctagtattcatgaatcttttttcatttttttctttcgatagcttgaaccttttttcatacaaccacgtaataagataatatgaatttagcgttgatctgttatagaaagtggaaacagcctttttacgcgaaaaatcataaaccacctacgtcgtagtgcccttttattccacgatataactcactaatactcgcaaaataaaataaaatattaaatttagttctagattattactgatgtattaaaaaaactatttatattttaaaaattaaataactgtgtccttatttacatgtaatagatgattgacttaactataaatataaaagtataaccaacttatttttctttagaagtatataaattacatgaaatcaatttatctgtgattaaaatttaaattaagatttaaaagcaatatacgtaaataaattttattaactcttttttgttcgccacatgtatccttcttcacattaatcttgtttgagatactctcaaatactgaatatatgagcagtagagatagtctcttttcctaaactcaactatgctagtaattttattaattgataacacaatttcattaaaaacaacattgaaagaaaaatgtatgtatattatgctatataataatatataatagtaaaactgttaaaggcttagacgaaagttcttaaatgttctttgtgattttaatgttgctttatggtatggtattttaaggccaatttagatcccagtagcataaagttgtgctgaataagatgttggatttgtgataaaaaaaataaattgcttccaatgcttttttaagatttctatatagtgataatggtgtaaagatattgtggtattgaactatgttgcgagcttgaatttggttagttataattctgaataaaccaactcaagtgtttagcgcttcattttcaaaatattcatttgaggtagcctccaccctggaaaaaccttggatatcatattattctttggtttaaggtttctagacagacaataatttaacggatcagttaaattacaaaaattttattctcttcctccaatcacaggttatactttttaatattatgtatctgttaattacataatcaacagatcggttgcatcatcatgaattttcatgcttcaaatgtacaaaacaaatacagaagattccaacagtggaaaattggacaaggagctcaacacaatttagcatggaaaaaatagtagtcacagattttatcaacttaaaaagcctaatccttgatgcaatataataccgggaaaccattagtgtgctttgacaacttgaggcagagatttgagaaggggcaaagagggtcttcgaactgtgtgattaagaagtaacataaatgtcagaagtgtcaaggctccagcctgatgtgcagtgcccagtgaaacaggtacatatgaaagaagcgttgaaattcctaaggtgacctgaaaccatgcaaaattaattacattatatactggatgacaacagcctctgggaaatcatatactagactactaacaaaaacaaacaccataaagtctttcttcctatttctattttatctatttatcatcatcatcttcatttagttaaagaatcagacaaaaacacgtggaataacaggtctgagtattcagttcgacaaaggaggcaatatatcgacaggcagagagctagctagaaacaacaatacaaaatgataattattataaagtatataaaactggaaattgaaattaagacctgaagagctgccatgccaacagcacctccaatcacagatcgtactgcaggatgtatctccagctttcttgttgaccaccataaaatggccacagaaatcagagttgcagttgcaagtatacggtgatcaagctgtcaagagcaatgcgaaacaccaattagaacttcatgttgttaaaactttggccgccaaaccacacttttgaggataaatttactactaaccaatccaacaataatggctcacaaagtgtttcaaaacatttcattcagttcaaatttctcaattcttgaaaagataataaaaatccatccaaaaaaaaatcaagaaaacaaaggtattattactatttaagcttttcagagatatcagcatggattacctgtacagttgatgtattctcaaagaaatttcgaatcagaggcttcatttcaaaaatgtcttccggtatccatgtatcacccatctttgggaaagtattaaaagcatgcccctgggaattaacatgtgagcagaatgattatctttatcctcaccaaaggctcaattatcatttcaagtataaatgtgaaaggcaagaaactattgaataagagaacatacagcatcatttccagcaacaaatgcacctgagacagcagtaagaccaacaagtacgctgataggcaatgcaagtctcctcactttagctgccccacgaacccatgttagcgattcagctggtggttcaggcataacaacagaaagtgcagtccagaagaggccacagtaaatagcaaatgctgatgtaagatgagctgcaagacgataagggcttacccttggctgagaatattcagatggtggctcctaaagaaataaaatgttattagaatctgacagggccggtcaatttaacttcaaataaagagaggaatttatattatttatgttccaacctctaaaccacttttgaccatccaccaaccaatgagaccctgtccagcacccagggcaaacagaacagagagtctcagtcctaatctcaacgtaatataccgcttatgaagaaaatatgaatatggcaaagcaaacataactcctagtgcccttccccacatacgatgtgcatattccatccaatagatgaatttgaattcttcaatcttcatgcctctgttaacactgccacaagcgcaaaactaattatcatcatgacattcataagaactactaagctctttgagaccaagtgtcaactcacttccacttaactaatcccttcccttgtttttcttgcaataaaaacacaatcagcactaaaaattgacctattcattcaattattctccatcactgtcatattaattatcatccccatactctgaaacacacaatcatgtcaatttttcttgcagcaaaaaagtttaaactattatttaaccgtgtaaattttatgacaaagtttgagaacagttatttaaaacattattcctaaatttttaatcatctgcttattatgatttgatttcaatcattaacaattagtcagccaacttcaagaagacttatttacatatgttaaggaatgagtatcttttctcgcagaaaaataaaaataaaaagtcccttggtgcatttcctaagttaatgggaaattaaaaaggtgtagcaagtgttttcagtttaccgcttgtactcaggtgactgcttatatttatcaaactcttgcaaccattcgtcatctgagaaaggagggagagtgccggtgaatttccaatcggtcattgaaagaccagatcgagtgagtctggttaaacccccaagcaccaccatgctgaacacccatgccgctgacccaaagagccatactccaaccaatttctgagcacgcgaacccccactcactagcagcttcaatccttctttttgttcagcagacaccatcttagaaaagttcctcatttgtggcacatgaacatgatgaccctaaataaaaagcatcatcccaacacaatttcctcagaactaactagatgtagtagtaactagtaactaatcattcacacataatagcatcatcatggaggaattaaaaaggaagaatagtgggtatttctgagaatgagatagagattaaagaattaggagtgattgtgaatataaaaagtaaaggaacagatgatgacccataagatcatacaagtttaaaagggataaaaattgaaaattgaagagtacccagatgagaaagtgaggtaaccttggggattagttgggatcggaaagcatgaatgtaatgggtggcgacgggaggggttaagaacttgaaaggtggtggttgggttgaagaagaagagaaaggcgttcctctaaggcttagcttgtgaattccgcatgcttctttgccgcgcttcaacactgaccacaccgttcccctaccaaacatctctgtttctctcctgcaaattgcaatgcaactttcagttcagggtttaaccaaggttttgttttgccaaacccaaactcaactactaaaacgcttattcccaccaccgacgtgtcgttttgtaggcctaaccattgtattgaaactccaatgttatagccttctatcctcaaatattattcatataatttttacacctttttctttcattgttgtacaaatttatttaaatataatttctcaaacaataattaaaaattaatcgggcaaattcatccttgaagacacaacttggtaagacgctcagaaattaatatttgaaagataaatttattatgcagattgacaaattgatctttaaactttacaacttaaattggttgtcaaaaaatataatattgtcaaattgatcatcgacaaatataatattgtcaaattcttaaacattagaacttaacgataaaatgatcttataaatttaagtaattaaatacgagattagtttgtcacactttttacatattcaaagactaaatttatattttttatttttgaagaactaatttgttcaaaaccaatttaactatttacccataattatataaataaaacacaagctggctgtggcctgtgggctggcctgttgccttattttcacttttttcttaaaaaatattacagtgttcttggttttagaactttgttcaggaagcgcttgattggtatttgattttcagcacttgatatcataatagcagcaccgatttcaatttagtaccataaatttatcagagtttatcgcagacttcttaaaaaattatccaatttatattctgaaggagcttattaatgaattttttggattagattttggagaatttgcatcaattttttttggtgtaaaggattagcaaaaagcccaacaacaaggaaacgcctaggctattgctagtaagctcggcattagtgcacttcaaaatgtttaaaatgtgattgatgacatttctagtgaatcactttggtattgtgtagtagggattgattgagcatttttagtttaatatttttctattcttcttagtttatttgacttctcttaaatttttattttctcattttaattcaatttttgtcttagacaaacaaaaggatttaattgctaattattatttattttcggattttatgctcacttgatctattttttttgtgcaggacctagaaagttctacagaacttcaaatgacacgtatgagtagtccctataaacaagggcggatctacgtataagagaaggggggcaagtgcccccccttaaattttgacataaaattaccataatactcctgtttttaaaaaaattcataaaaatatctaagaccaagaccacgagagagaccacgcgcgctcagtgactcagtccttttgcaagttctgctctgctctgtgctctccacgcgttctgctcctcctccgccactggcaggaccgccaccgtccaacgtcggccaccgccgaactccagagcctcctcgcgcaacatcggcacgggcgcacggcaacacctccgactctccgaggcttcgactccgagctgcatttcgcgcttccgtttctgggcttctgggctctggctgggttcttcaatcttcactgtcgggatcttattctaaggtctcgataatgccggaaagaccaccttacttcacatgctcaaagacgaggtttccctttccgatcccttttccgcttaagccctgaatcgctttaaatttactgggaatgttattcttttagttagaatccttttgtacaatttaaatattattacgaaattgagtgtttcaaagaagggttgcatggctaattgtctctaaatatatcctgtgcatgtttttaaatcccggttgtgttgtgattagcaatattatggaaaattgtggctgtggaccacaatttaaagtcaatcctgtgtatttgctgatgcagttgaggaagcctaaaaaactgcaatattgtgctcaaggttttaaaaaaatatgtgcaaccgcaatttcagcctcagtgtcaaggtttttggggtcattgtgattaatttttaaccatctgaatattgcatttgtatgcaatttttcataatatcaaggattacaaccatgaccacaatctaaaacctttattgcgttgcaattgtagttgtggtttgcaatttaaaatcaattatatgtattgacatgttttggtcttatgctttttttgtgtcatctaacaccaatttttttctttaaatgtgtttttctcaacaattattttctggttttagcaagcttaacaaattgatttcagatatgtactttgtaatctctaccttcgtgacattatcatagtttattggggctagaatatgcgcctggttattggtatttttttaaaatgagaattggcttggcagagactagttcaacatcagcctacacagtatccaacatcagaggagttgagtattgggaggatcaagtttaaagcttctgatcttgagggtcaccaaattgcacgaagagtctggaaatattactatgctaagttctccctctcctaacacagacacacatttgtgcatatatttatgaagtgcaccctaacagttgacttctcaactctgttttgcacctttgaaagcatcacttgatggaacttggctatatacctataagatttgtttggaatttaggattaaatcttactcctcaatctgatacagttttagacttttggtctacatgctaatattaatgtgtggtttgacttggaatatgtgaattttccgttctagctgttaacaaggataaagtttggtgtgtgcatcatggcttttaagaaattacatgaatatttggaatgatttggaacttgaaatgtgactatttttttctttttattttttgaattgttgatgcaatgatgctgatctaccacctgcagactgcagttttgctgcctttgttgttcggattttcagccacgaccacgaccacttcctattcgtacggtaagaacgcttttttatttattttccgttataatcttccaaatattgagtgccctccctcattaattttctggatccgccactgcctgtaaagataagaaaaagatctacaattttgtcagagataagctaaggtcaattctgtcattttgagggtcatttgaggcttgaaagtcagaagctctgcacttgaattttggactgcgagttacatttttaatggtgtaattagcataattctagtgaaacactttggcattgtgtagtagggatctcatatcacaaaagaaaaaaatgaactcatttggtggtctatttggtggtgctcaaaaggccaaaaacatgcctttgccttgcatttgctctcttaatcttggtactggacttctgttttctttcacaggtgcaagaatggagacaaaaagctctttcatctttttctgcagtctatcaagctatatcagaaaaaaaaaaaaaaaaaaaaggtgcaaggattgttctacttataatgaatttagtttggagataaactggtttgctaagcatagttaaggcctattttattagtaattttgattctttaatttatatacttttaccctagactcatgccaccattatgtgaagctggaattccaagggtgtgctatcattgaatctttagtatcaatacttgcttgcatataaatcaggcttacatagaggaaatatttggtgctttgtttaacatttgtctcctgctgcagagtccttaggtttgttcagaagtacttgttaaattgagaggattcattcagagttctagaccaacccaacaaggacctgctgtcaatgtagatttctcagtaactgctttcaatgagagcatatcagcataggagttccatacttgcagaaacgccttgagtaatatttgcagtggagcataaaaaaattgaagacatgtaatctttgaatttatcaaatcaattaattctccatttaaaggatacgcgggctaatcataatgcatttctatccgtatatttcttttctagcttaacgaaactacaatgaacttcttagaaatgaggcaaaatgaaactaaagagcaaccaattcatactgtatgggccaattcatactgtatggcaaacgatgcaaaggctgcatttacattctgctcaagtatatcacaaaaaataggtagagaacttcgtgatattcattcattgcttctggttattccttacagggaacctaacatttcctgctattgctctacatacactcatcatattgttgcgaactatggatacactatcaagtctataactctaaaccccttcatctagagacaaagtctctgattcaaaaatcaatagaaatgctccattggtataactctttctcaggtactctcaaatcaatagtcaccaatccagattcttcctcatacttgaattctacttcttctgaatcaactattatcaacttaggctgagctgatgaataagcaccaaattggccacaaccacggactttcatggctatatttgtactttcattagatccccaactaaactcttggacagcccctcctgaattgaacatatttattaaaccaataggagcaaatttgacaccattgctcaattccttcacgggaactattgtgaaaacttcatattctctggttttcaaggtaactgggatggatgcatcctttggaaggtaaaccacttctcctgcaaattgacatcataaaaagaccattacacaaaagaaaatttgggttaaattttgtaatctttacaagtatcattgtcaagccgaaaaacataccaccaagatgggaataaataatggcatctcctgtccatttatcatctgctaccctggataaatagtcaacatctttagccctaatgacacctgtgacaatgcctggattctcatcgtggataaggttcttcttgccaactttgcaccacccagctccttggcaattgaataccgcaacaactccagaaaaatcattcatgttccaaatcttcagaagactgcaaaagcagcatacaaggagttaagtaaaatacaaatataaagaagcatgcatactatattttgtagtagagtgtaaagagtaagatactacatcaattggtcaagtatataactatataggtagccaaatcattttggattctttacctctttccatctctggcaggatcagtaaataagcaatcctttgttggtcgtcctggaagtttagcccttaatatagaaccatcaggtagtgcaagcttcttcaaaagaccaaagtcatggtgtccgggcttgtcactgcacaatagaacaacatccaaaggtaagacatcatttatcaaataaaaaaagtactgaaaaaaaaaattactacaagctctactcacctgacataaattggacatccccctacagctcgtgctgcaccatgatattcagccattggatgtaggctctgcatattgcacaagaagttaattagctcctgcagaagcaagttcatattttttttcatgaaaaaagaaggaaggatcctgtatttggtaacttacctgaaacatatcccagtctggctgcataaattcaccaaggaaaatagtattgtaagccactgatgcaatgtgaatcgtgtgggatgcagggtctcttggccagaaatcatctgatgccctaataacagctgaacgctttgcgctacacaagtaaatttataaagaaaatcatcatcatgaataaaaaaaatctattgttattgtgttaataaaagcattcactgaagttttataagcaatccatacctgtataatccatctgtgttgtgactcatgcaacaaatgattccattgtcagggaagttcctagcgattgatgcctccaatgcctggtggtatttccttgcaagtttcaccctcccaccatgtcctgctccaagagtttcaaggatattctgaacatcaactttgacaccatcaataccagcagatgccaaatatgagtggagttcatcgtaaaaatgaaaaactttctcaggattcacaaggccgagcccattgatggcaattgttgtcaaagcttcatctggttgatttgactcaactccaggagatgagatagggaaggccatctttgattcgtagtgctccatgcccggaaccccgggtttaacacctccccaatatcctgttattgcatgccacacatatacatgcctgggaaagattttccaaagatgatcatgagtactatgtgtgaactgaatatcttatggagaaatagaaacaataaaatgaaaatggcaatactttatattatgctctagtttgatttcattggtcatatgacgaagtcccaaagccgggtcctctactcgctgaccttccttgccatctttctggaatttgtgattctctttgatgtttgttaagcgatttgcaaagctattggacaagaaagcacaaaaatgaactgattcaacaatgtaaaatggatggaattacaatttgataatgaaacttagaaaggaagtacccacttggctgaactatcagatttccattcaacaccattggggtccatcccaacagattgccatccatcatcaattataacaaacttagcaggaattccacctttctcaaagctgcaaaaataaaaataaaaatgtaacagtcacaaatttatgtgatgcggcatatctcataactatgtccattgtccatggaaggaagtaccacctctgcaatccttgcttcacattctctgaagtgacattagtgtagaaagcatcccatgtacaccatccaaaccagttcaacatatctggcatctgaatataagtgggggggaaagtaaaattagaggtagtgaactttaagatgcagtgctcagaaataagactgtctatggaatttccattttagggagggagaagctatgtaccttctttcgctcgcgatgtgcaaaggtctgtaagtgtttctcaacagtcctaaaaaaaattgcaaaaaattaaaataaaatcaataacttgacttgtttagacatataaaacactgcacatccaaacgtgcagttatgttaaaacaaaaatattacttcagaagattaaactcaatttttgtaataactaaaagtcaatgatcccaacccgaaagccttacttatagatttcgatgactggtataaactaaaaattagggaacaacatagatgaaatttattgaaaggtggtaactcacttgacagaatttgttatgacttcaaaagggtcggatccaaccccaatataaaccaaatgagtcccatcaaattcttccacagcaggacaacctgaaatcagatacaaatttcatcactttgcacaacagcaaaaaaatccccacatatatgcgaataaactaatgaattttttcttcttctgaagatcacataccactttccacacagatttcaatctcgtcttgatcattcccctgaagaactgctctgaaatctccttccagaaggggtaagaaaactgcataggtagcagcaccttggtctcctcctccttcaatatcagagccactgtgtgcttcaacaagcaagaactgcgtctcaatggggatttcttgtccgcaagtgcccattctctgcgtcatccaccacatcttgaaccggaaaacacacataaatcgcaaccccctgaaaaaaaaaaaaacatcatcctaggatcagaattgcagtatcctaaaataaatattattaactatgcaccaacacacactataagaaacatcaaaagcaatccagtacatgcacatgcacttcctgattgtgacaagcaacaacaaaaaatacagcattcacccaaaattacaaagattttatttttcaccaacaagaagaagaagaaaagaattgaaaagagaaaagtgaagagtacatactgaagcttgccaattgggaagactgtgcggctacccttgtgatgggattgaaccccgatgaatgccccattgagcaaagcaccaccacatgcaggggaaacaagaaccttgtcatggacatggctcagcactttgttccccaacaccatcaagttcccatctgcaacagatattcctgcccctacagtcatctttgatgatttgatgaatcaaacacaagctcaaaaggaaattgcagcacacagagcactgcaaccgctctactgttgtttgttccaaatcaaatccaaatgagtcaatgcagcatgggaaggagagggaagggtatttatagcaacaggataatgataatatcacgtaaagctgtgtcagcagggtgcccaatttgttaggaactattgccattattgatccataatttatgaattatcaacaccatgcaatcaatctagccactcccagactaaagtctctctcttttaagaaaatttgctgctacaaatattcatgtggacatatcttatatttatcatttatttacaacatactttgtatttatttatttttgtcttttgtggttaaaacttaaaagatcggctaatcagaaaggtaagacattcaaaaacttaaggacattgcaataacacatctttcaagtttcaatgacaatcttttttcattatttaaatagtgcaccgattaatcttttgttattacattacacgtctcttatttattatagattcgtattgcaaattgcactattatacaattcgtaaaatatagtaattgacataaattatctctccaattattgattaagaggcatagatattttgtttttaaaatcgtacttctttatgtataaataatacagtgctatctttttttaatgaataaactaaaataaataagtaaacataaacaataaataaacttacggtaattattctccgaaaaggaaaagaaaataaactttatcagcacacgtgaaagcacaggaaattgtgtgtgggggccacaataatgatacttgagatttgagagtcgttgattcgcagagtggatatgataaggccattgaggtgtaggtggagtgacgcaagggcgaagcagcatatcacaatcagtggaagaaaaatctatgcgtcgtgagtggtgaaatgacctacgtggcatatagaagatggggtccacgtgacgcctatttcaagaaaaatcgtttttgatcagacaaaaaaatccggtaatcgggtgaaaggcgatgaatgatctacaacgaaggcacacgtgaaccctatggagtggcgtcagtttctctgatattttatagtgcaatttgacttgaggctctgctgtgcatgcatttcacttcaattcattcaatgtctttgcatcctacattgattttttttatgcaacatgttagattcattaaacaaataaaaataagaataaatggattatgaatttacattgtaaagtagtagattttagtttatattatttaatcacaaattatatataataaatttactaattttataatattatttttaaaagtcatgaataataatttctaattaataatataaaaactattttatattttatattgtgaatacatgactaaattctaaaataattgagcaatgaaaatacaggaatggttcatgtttacaaaaacgagtagtatgacatcactcagaacaatatgcatgccagtgacgtggatgataagattacaactcgttcacagctcagatctgacttggcatttgtttcctaaaatttaattgcatagattaaaagactaggcactaacaagtgtaaaaaaattagaaaaaaagactatcatctaataaaaaattataacgtgggataaatttcttaatttttataatatttgttttacaaattatattaataatgattttataaatttattattaaaataatagaaaattattttatattatctatagttaatcattaaactttattttttattttaaaaaaaataaagaattagatatttttcccattatattttttaatgaaatttcatatcttccctttacttttttctctctcttaaactaacagaatatagataaataataaacattaagaagttatcaccaaataccaaattagttggatttattatctaaacattcaaataatgagcgatcaccccaataaaaaacttcaaatacaaaggacttgaacaattaaattttttaaattatctcttagtattctttattaaataaaaatattaaacattttttaatatttttttataatattgaaattaaaaatatataaaaggatacaatattgtaaaaattgtaattgtaatagtaaatttagttattttgaagcttactccattaaacccgaacattgcgacgctttcacattattagccgtaatattgttcacctgaactaaaattatttcatttcagccatttatttataacatgagttaatcaaccactgaacaaaagttgattgagtaaaaagtaaaaacttaaatggaaaatattcggctatgaaattataagtttagttttttataattttaattttatgattttgatttctttatttataaatcaaagtaacttaattttatgtgttttcataaaagataataaattactgagataaatattttatttagttaattttataaatattttatatgagttactactaaagagttattttttttttccaacaagtcattggctcatttcttttagacaacttctcgagtttaagttttctggatgaaaaaaatgtagttgagaaaggagacttcaataaaggtgatcagttaggtttctcaatcgagatttgccattaataaaattagtagatacttcacacaaatatcatagtaattaaaaaaattattattttttagaactataaaaatttataaattaaaaaaaattaatatataaatatttttaagtttatttaatacaattttatttttattttatcaatttcacaaattaatatatatgttattttcaaaaaatattttgtaaatatatttttatgtaaaaattatttttaatatagttatataaatcaatataattgcatcagttaatatttaaattatataagttaactaaatttattttaataagtaaatctttttatttaaattatgcaaatttatttttatatataaataatacaaatatcttaattataaaaattaataaatttttaatttttttagattatttgaatattattttaaatttatgtaatttgtataaattatataaaataatttttaaaatgatatatatattaattatgtaattttaaaaaatattataattaaacaagaataattttttatatataataatttattaatttatattaaaataaaatcttatgagaaaaataaatacataaaattaaatgttaaatactttattttaatatacaatttttatgattttaaaaaattaatagctcttgactaattatatatgtaaaagaatatttatataactgactaaacaaagtaagtgtcttaataatttatttttttggtttttatataaaagattatgtgttcaatttctacttttattttttactttatttaatcctttgtcacataagcgttgagttaacggtctaaataagatgattaaatgtatttagagactgaattcacgaatgcaaattatagaaaacaaaaataacaatttaaccttaacttatcaaatatttatttgtacttaatgcttcttttctaagttaaactactttttaagttttctaagtcaaataattaatctttgttaaaaaaatgagagaattctgagtcaaatttcattttccctttcctttccttttcaagcgttgaacgacaaatttgataaattctcaatatttgatcatcgctcacatgagcaaaaaaagtagaattaatcgcattacaaatactcacctcttgcacttatttaatcatacttccaaactctacacagcacacgctcacatatacattgtctctaatttccttgatacaatttttttcccttttctccttttatttttgttcatgttccaactttttgtcatggagttcatatatcatgatttccaaaaccaaagaactccatctccaatatcacaccctttttccacaattgcctacatttctagatgcttattataaggtaacacttgtttttcttcacgttcctctcaagtgatccatttgtgttcatgtgttgttatttaaaaaaaaaaaaagtttggtaacactagtttatttataggttgtgcgttcgcaccaagtgattttcctgtcaatgtttcaacacctagtgtttttccaatgtcaatgttgattaatgtcgatgaagcatttcaacgagagttgaagaatgaacaaatatgatgatagctggagaatgatattcgttgacgagatgacattagtctgacaaaaagagttataagagaaaattatgaggaaaacgaggtcggagaaggcgttaggcatctcaatgcaaagacaagaggcaatcttggccccaaaatgaattttgatgtctttgaatcaagattgttggggtaagaactctaacacatttggtgttccaatatataagtggtcaacaatataatgcacagacttaaagggatcaaatgatcacactagttagtgtataattacgtatcccaatgtctggaggcttcacactatgcataggtaagggagaaagatattgtatacagtcttatctttgcatatgcaaaaaagttattttcagatttgaactcatgatcaacaagtcacaaaaatacaactttatcgctgtgaatgttgatgcaaagcgcaaaatagtgacacttcgtgtcgttgataactatgagcatttgttcaattagtttacagaagaaattttagcaagagtggggttgcacgctatgtcaaattactgtgaaaagtgagaaaggattaaatgatcatttttcacagaaaaaataaaaggctcaagaaacatccctgaaaactaaaaagaataggcaaggacataaaaaacattattatggttaaatgaaaattaaaaaaaaaagtgtgttaaatctaatgaatttgttgttcacatgaattcaggattgggttcaagtcttgattgttagacatttcaacaatggcggtgcttgagataaaagtttggaagtgtctaaataattaagattataatatatttcattttgatgtagatttttatctttaatttttattatggggcgtaaaatgtacatctactagttggcgagaccttatgatgtatgagatgtctattttgtaaaaataattaattatttttacattgtaacccatttataaaaattaataaatattgtatacaataaactatataaataatataaattgattatattcttgtctaaccttcaatgttatttttaaaatatttgtacaaattattgaatttttattgattttaggaaaaaaaaatcccatgatagatcgccttataatttagcatttttatttttttgtctttgtaatttattttaatttcatatttttttatgtttcgtccttaaaacaatttaaataatgctttaaataatgaaaaatattatttaaatcacctaaatgacaaaaaacaaacataatttaaaatgactaaaaccatttttatcaagttagtagaacaaaaaatgtttaattacaaaaatttaaaaagtatttaaaccatattattattattgtaattttacatatttttttaaaaaaacttattactttttggtgttgaaactgtaattttacaatgtgccactcaatgactgaccaattcaaatatttaaattttgtgattatataacccaaagcctgaacatttatatgatttaaaaagaccgcacatttataataacacttactttaacacaagtagtgcccagtcaagttaagaacaccaccttacaacagaatatgcaaataagagcaaaggtgtaccaaaaagaaaaaacaaagcaacccatgcatctaacaggttctcgcatctgtgcatactagcttattagttagagacaattaatcagttagatgaaattaatataatcttatagtatttgctgacattttaggacaaaggctatctattcaagggtatcatctgatgagtgttggagtaaaggacgagggtgtcacaataatttgaaatgttgcatggacaacgcgagacaagagttaggagaaaaatagttgtcaaatagagatagagctgccacatgcctcaattgggtgatacttcaaaattaatctctcaaataggaatccgtacacccacattgacttttttgtgcatgattattatgctagattaatgcttctgatatatgtgatttcgtcgctggcaatgcaacttgtggaatttaatttaatttcaaaaccaaaatgaatcaagatttgactcgtggatactgaatgtgaatgacttataatcttataccaaatttatattagaataaagagaacttcccttcacctttttgttttttgtttttctaacaaaaatagttaccgtatacgtacctatttggtgagtagtacacggttcttctctgttaagcaactgggtttttttattttttattttatcagcgttaagctactggattagtgaattatatgagcacattcaccaaaaaaaaaaaaaaaaaaagtgaattatatgagcacgttgattgtgatttaccagactaatcatgtcaacgacgcccacagtaattgagaaagtgtcccggttctgtgctgggctacctcactcttctaacttctgcagttgaattttcaactgcatcacaataagttaaaaattattcactgctagattcaaaactgcatgtacccgttggtccatttgaactgccagtgatcttgatccctagtgaattatcaatttaaatccccttttcccttttttagctggcgccaaaattaatttagtacttaaacatgctgatttttttctcaactcgtattagttacgatgccaaaaacttttccttctatatcactattctgaaagataacatcatatcttctgtgagagaaatgacaattacattttttttataattgacaaaaatttattgaaaattatcaattttggtgaaatttatttattatttaatgattatttctctttacttaaatgttgaatccaccaaaattgataataattaataaaaaatgttaatcacagagaaaatattgagaagaaaatgttacacaaaatatcattaacatttttctactttatgaatataagatcagtttagtgttattcttcccctttatgctcaacaacttaaatgttcaacttttaatatgctattaaagatttaaattgtttaacactgttgtacattagatggatcaatctatataatgagtacattaattgcaattttaggtgctaatggcgaacaaaatttgcaagtcaaaaagatttgtcaactatataactcaaaaccttggtagctatgccttttattatattttatcggtacattcttggtgatagcatgaaaaaggcataaggactgccatataatttgcaggtgcaatatatgaacgcaaagcacctgccaattaaacagaaaaagaaaaatattgcacaatcttgaattcaaatacgaattttaaatatcattattcaacataaattgactcctgagattcagtggctatcagcctatcacgcggaatcaaacttcaacttcgttcataaaaaaaaaattaattataatttttgtatctccttttttatatttatttcacctccacgactcactttattttattttccctggttttgtcgtacccacacgcatctcattttccttaacacgttgcgaaaaaacaattattctaaaactttctccactaaaaaaagacgacgtggtggggcagcttctagaaccttttgcaaacccaagacgaagttgttattgtgcaccaacaccaatacctgctgccatttaaatgaccactatacccttctctcaatcttgtgctattctccatctttgaccgccatataaaaacctctctcaactctcatttcactgcacaaaacaaagctaaattcaaccaaccacaacaacaaacgcaacattttcatttcccattatacccctcatcgcagaagacctcagaaaatatctcaatggcgggaaccctaaatctcacgcctctcaccggtgccggcaggactctccggccaccggtaaggatctcaattcgggcattcacggcgacggcgatcgattcccggcgagcggcgagcctctacgaggtgctccggatcaagcagaacgcttcggcggtggagataaagtcggcataccggaaccttgcgaaggtgtatcaccctgattcggcgctccgtcggtcggaatcggacgaacgggacttcatcaagatccacgacgcttacgagacgctgtcggatccgtcggcgagagcactgtatgatctgtcgttgatggcggcgcttgatggtaatcgctcgttgtcgtctgtggtggctgctccgaatggctcttccggattctactatcagacccgtaagtgggaaacggaccaatgctggtagatagcttccaagtagaagaaaaaaaaaaaacgagaaaatatattttctgacattaacaaatttacacggaaaaaaaaattaaaatgtagaaacgaaaacaaaaaaacgattctgtaaattctgtctcatttttatgtagtgctgctcccaggtcattttgtccatttcgtttgggagaaatttctgctgcaatttcacaaccatacgtctatcggccaccaaaaaactttccgtcgacttaaaaacaattaaaatataaacacttttggacctttgccacaaaatgtattacgaagtcaaagtacaaactaagattttttttttttttaaatagtcattttcatattcatcaatatgagaattaacaattttattataatgaaaatttaaattttaatatttgaaagcgaaaaaagtgtaatttttgattggttattattaatgaaagagattaagtaatacatttaaggagtgctttatatattcatagaccaaaataattatttatttaaaatataatttaattttcatctttttataatttatttgttgttttaaaatttttattgtgataatattataaagtaataaaatcaagttgagttttatttttttaggattaatgtaactactatacatttttgtttgagtctcatattttgtactataatattagaaatttcaaaacaataaataaattatacttattaatcaatattatgtttattattatgtttgttctaacatgttttttattaaagtatttattgtaatagtatgattgtaataattaaacaaaaaggagagaatatgagattaaattatattttagataaatattcattttcgtcttgaatatgtaaagcgttgacaatctcgtatatgaatgtgtcaaataaatttttggggactaaaatttaaatttttatcttttaagaatgaatttatcaatattatatatatttagggataaaaataaatatgaatatgttagatgatataaattataaaaaaaacagatacaaagaaaaatggtgtcaatgtaatgtatatactaatattataatgtatcatcactttatgaatgataatatattttactcgtataatatattaccttgttagtttagattagtgaagcttgtgattttgaactattttcacaaaacttcattaattttgtgattaagatgacttattagcgatttaaatagcctaaataatacatttctagtaattaaaaaaacacggagaaataattgaaaataattattagttcattagaagtattctattctatacacattatgtgggaaccgatttgtcctactgtttcttgcaattgttttttcttttttccttcttatttattttttatttttttagaagtattattagtattactgccatgttagcatctgatatacttggtcaaaggttggtcgtcgcatgaaccatttttatggatgtatcattgctaacattacaagcaaactgctgcagaagtaaaagcacccttccttggctcaaaggaagaggaatccagagagaataatagtccatgatcaaaatatttatataactatgagaaagttcaaacgagagaaaaacacagagcaatactaataatcacaagagcttaaactgttaatattgaatattaccaggcttgaatttttttatttcggcgttggaaaactcagtggatcatgtttttgggtcaagagtaggcttaacctgttttgactacagttgtttcattttacgtagcaagcccatattttatgggcccatataataatatttcagctactggcattagtgtccaaaagcaattagacaagaaaaagaaaccacggccattagttaatactactagttatgttgattgttgggaaaggtgcgttaaattttcaatgcactttttattaaataaatattacacaaatcttaataaacgaaattttattcaaataaattaataaaactcgcattaaacaaatttaatagcaaaaatactaattgtttttcataaatgattggagagagaataattaagtaaagatataaaagaaaaaataattaattcatttaaaaaatatttttttataaaatagataaataaatttttgaaaaattcttataactaaaaacggaagtaataaataatacgtttgtgactactttgttgatgttaatactagattataaaaactggaattgatgattggaaatggaagaaagagacgttaaagtatagcatatgggggattaagtaagtggttagtatctttcagtattaacaacggtcaacttcagcgtatggaccaatcaccaaatttgtagcctcccaaagcttcttgttgtaacggactcaaccacttcaccactctcctttaacgcatcaccttccacgtttcccatgaaacttggcaacaaaacgttcacgttttcgtttttatttatttattataacaatgttattttttaaaagaagaaatattgatgatttcataaaataatcctcacttatacatatttaaacattgtataaattacaaaatagttatcaaaacattttttaagatattgaattcgaataataataaaaaaaacaaaaacagaagcctaaataattttcactctccagatgaatctattcaaattaacttaaattagtggttttttatgcttgttaaataattccctcatccatataacagttgaaactgaatatcaaaagttaattctaaatatatgtattttgtcttgaaaatttaaatatgttcctacactagttactatcttataattttaaatacatggaatgaattatcggttttacttatgtgatatggggcatctaaaaagttgagaaaaagataaatttcttttgttccttttattttattaaagggaatcttgttttaatggattagatagctttccttataagtgaacaaaagcgtcaaatcaaaacgtcttgaattggtgaaagagacaccaatgttgcctccccttccttctatttaccacttttacacttctttctatttcccttttcttttaaattccgcattatctttctcaattttcccaccacctcccgaacagaatcagcacccgaatttcccagatccgagatacccagaaggaaaagattaaaactttggttttttcatcgatctctggggaaagatgtgttgtggggggagagtttgcatgctttgcacgtgtctggttctggtggtgatcgccatcgggttggtattcgggttcggagtcttcaagcatggattccacaagatcaaagacactgttagtttctgcgattcttgcggcggcggcggaggaaggcctttcatcggttatgcaccgccgccattgttctagttcacagcatcctcttgttctatttccttcttgttaattgttctggggatttgtttgtttcttttttataaattagcattcgttagcgttcatatttgtaattacctgtttcttgggattcatgtttgatttaatattcatttgcctttgttacaatgctgtcactattttatctgtttcttttcggggtttcgagtttggttttataattagcgaattgcagaatccatgtttagaaaaaaaagtaatatttttcatcaattaattatttgaagaaaaagctcaatgcttttctaattatttttctttggaaataattatgttaacatatagtaattgaaaagtcattttgttttaccaatttttgtcatcacgttaatcatttgctgttcattcaaattttaaataaatagctttttcttttttgacagcattaaataaatagcttttgtttcctaatttttgaaacatcttattgtctaactaacaaattgatgatacatcaaaggggtaaatgccgatatttgaactatatttagttcataaatttgatttttatctgaatgtataatcaaattcagaccatcaatatgtacccaaaaaaaatcaaaccatcaatatatagttatatactattgaatctcaatgaattagcccgaagtgagagcaagagattcgagagaaatggatatggataaggattcggattgcatcgcacttcttatgtgaggatgaagattttcaacattaatagaaaaaagaattacgtggttatgtctctctgtttgagtcgtgctccacatgtatagactctctggttaaatcataaaaaagaaatgctctttggttaaagtgggttttgcttgtgatggttttctacttgacttgccccctaatattcgtactttgcgtgtttgacataattgattaatcaaacatgcttgattaatggtttgaatcattttaaccactacgcttgttgatactagtatgttttttttgcccccagaatatcctctccaaagcggcgacatattgttcggatgttatcactttttttttgcgtagagaaaccaaatgcaattaattctagagaacaagaaaaatagtttattcttccttatttcatttcttttgaggggcatttcctcctgtatatctggcactagctatcctatcgctgataatgtagaattttttctacaactcagataaaaaggtatatatacattcttataaatcagatttttcataaattttaaaataaattatgtgatttatcattaattttaatggtaatgttgatgtagtttagttttggtcgtaagaaaacaaggggccacaaaggcctagagaaaaaggaaggaaaggataaggcgacccaacccaagagttataatcaattacaatccttaagcccaaatctgaatagccgaaaataagggtgtgccatggaccaaaagaaaagcttgggaaaatgcagcttggataagtttgagtgaagctggacttggattcttttagtaagattttggatatacaaaaacatgatttaaatataaaaaataacatggtttaacttgaataattggaaaagcctctgaatacacaaagcaaaaagatagggaaaaataggagcatcctatctaatacctagcatgggatcaaactcctggagtagctctccattccataacattttcatactgggggaacaaatacaattccaaagaatatcaataaacttggccgggcaaccaatgtcatacaaagtatcattcccaaactcccatttcaagcgttcatagactttctccaaatcaattttaatgactattcaccccttagctcccttcttctttctcatagaatgaaaaatttcttgagcaatcacaatattatcagtactctatctattgggaatgaagttgcagtaatacgggcagatatatctttccataaaaggcctcaaacaatgagccaaaatctgtaattattttacaggagacattacaaagactaattaaccacgtgctccactttaagaataagagtaataagagtttcattaacctcagcaatgacatttggatcatcaaaagccttctgaatcatacttaccacatctctcccaactactccccactcactaattttcttttacatctgcatcactgtgaagaatgaaaaggtaaacaatcaaatcataaatcgtttagatatctgcattaattattaattaaagaataaagtttattgaaatttaacggaataacatacatacataaataccaattccatgcgccaatgttgaaagggttggatttgcggattgtggaagacgagcacatgtagtttccactctgtatgctgcatagcataatcgttgttcatcctttccttcctatgatatgaatcatatgataagtgttgaatgtcttatactttatccaaaaatgttagtattgttatattatttcacctttcctccctcactctcactctgtttctctcagtaggtattaaaatatatataaataaaaaaatcaactcaactcaaatcaattgaactaaactaatatctagggacggcctgtgcctaggttcaagacccgttgctggaaggaaaataaaactgtttagggaaaggacacacatttttatgtattttttttgaaaaataagaatttaaaacttttgataatgatgtgagtttatccaatattaaaacataagaatatcagatttttttttcatttcctttatctcataaaagacatacatttttataatgaaaatccaaatcttttcttgaactataatgtgttatatttctataacaaaaataatatcatgcgttagacagcgggggaaaattactcttaagtaggataaattgatgatacacaacttcagaataaggacatcaccaacaaagagggatttaggtttaaaaaaagaagatgtaaaaaagccaaaggtaattttgaatgagatatatggaatataattatcacatttaaaaattggtcaattcaaacaataaaacctaataaaatattacttcgattcacgctactttctttcactttctatcaacattcgaagcaaagcctactcgttaatacgatgtggacaaagacttagactttgtggaacataattcttcttgtgatcaacgttaacttttagttctaatttccaggtatattcaacgaaaggtttcaaaccacatgttccatgcataacagtcatggaacattggaacgtaacccaggagaccttggcgataattgccccacaagaagaatgaatcaccattcaccaatgatcgataatatccaatgaaaaacagcttcactttacaaaaaggaattatcaattatgttattgagacaataaatctttaaatttaattttaatatatataatgttagcatagaaaattaccatgttatgataagaaaaatcatgttattgatttaataatgtatcattaaactcattaaataatgtggtaacacattgttgaataacaatattataaattttgtatactttttcttttttgttgacaaacaagggattgaggcacccctggaagaagattaatatacttattaatttaagattgcaataaatataatttttaaaaaataatatacttattaattaccgtacttaattaaatttcagcatcattattctcttgtatttcgctatttacttaatcataaaaaaagaaggaaaaatgacatgaaagaaaagaagattgggcagagtatttatgcggataagccaagaaaaatgaagagcctgagggagtaggctcagacgaatgcactaaccaattgtaaatcgtaaaggaacaatatcattatattcagcaatttaatcttaaattattttcagcaatttaattctaaaatctattaacttttctttcaaaattttaattttaaaaacttataaattatttctaaaattttaattttacaatgtatcaaatcacttggaaaaatgcaatcctgaagtagtttataaagtacttttgaaaatgagtttacaaatcacttctagaataaaattctagaaaaaagttcaacatatcttaaaattaaaataaaaaacaattacatgctaatcttaaaaccattatgaatggaaaaaaaatttctccgagtatttaatataatcgaatattcactcataaaaataataattgtattttcataactcaaactcaatattttttattaagttaaaaaaatctggtgtcaattaactcacgtgatcgatgattacttttttgtaattaagacaatacaatctcaaatgtttataataataactatcagttatgcttaactagaaatatttttttttttttgcttattcaatttataaaatcaaagaagacaaatatcaaacacatattatgttaaaatgtaatctttccattgtcattttgaagttaaattaacacattttgaatttttatgttgacttcaacatttcattaaactcgttattaaaataccaaagtctatgaatcaatataaagatgcatcaatatgtttttttgtgatttcttggttaatatatatatatatatatatatatatatatgttttctcttgtaagttgaaaagttcttctcatctcaataacttatgtgtatgatactacctctttttatttatttataaaaaaacaaactatagtgtaaaaataacaggagtaatagtaattataactttttaagatttcttaaacaagtacctattgtgaatgaatttttttataattctcaaaatcgcatctcttaaaaattaaggtgacacacttaccattagtcagaacacttcatttgtcaatttcttgcatctcagaattatacacttaaattcattaattgtcaaatagtttaactcagcaaaatagaatgtaaattgttgtaaacttttaatacttatttgtctttgatttctattttctactaataaaaaaaataataattagtagttaattacaagtatgaaattgacactcccaaccgaatctggcccaaatgtggttttgatgaatcgagtaggcggcgatttggtcggttctagctttctaggaaatggggaagtctaggaagagaccatcatttgtggagggagaagatttttttttttcatggtaatttgtgtatccaatacagtactgtagatattccgtaaatataatttttgcaaatataaatttaaaaaaaaatggacaacttttgaaagaaaaatttattcccacgagcaaacacaagatatagagaatgaacgtcacccatagaaggaagaaattttctccatgaaatacttattattagcctataaaaaaattaaatacttattatagatttgtaagctcttctacttgtctcacgtctttctaatttttgcatcatttattatctctggttttcagtacataacacagtagttatatagtacattataatttctcatcccaaagtcttaacatgatttgagaaaaaaaaatcaacttgcatacaatcaattttaatatttagcttttggttttaggtgcttcaagttatcattttcccctattaacattatataatccaggcagcaacttgcttttaaggaccttctcttggtcaaatagaatagaagaaagagcactagttaaaccatggtataattggtatacacgcataatctaagcccttaatcaaactgactattctcatttacattcacatttgacaaagtctaaaaccattcaaaacttaaaggataagaaatcaacaaagtgagggagctctgttgaagtcattcttttagcaccttcccaaacgttgccgcatatataccaaaaagcataaacattaaaaattaagacatcaatgtggtgcaactttagctcacctgtgtcaccttttgataataccaaaaaaaaaaacacattgtcccctccattattattactcaactacaaaagcttttttttttttccctcttcacttatattgatccatcaccccatttagaataaataaacatatcacttctatctctccctcattcacttccattggcctattttagtagtgcaccttttcaaacatgctagcctctgttgaagaagaacttggcacaccaatacaaccaaggaatcaacattctcagcaatcagaagcaccaaattcccttgccaacactagagcaattttcgggcaacctcgacttcaaaggacaaaaccaattatatggtgtgctgcaatactgtgcttcatattcagcctagtgcttatcttctttggaattgcaacactgattatctacctttccatgaaaccgcgaaaccccacgtttgacattcccaatgcaagcctcaatgtggtgtactttgactcaccacagtacctcaatggtgaattcactctccttgcaaatttttccaatcctaacaggagaattggggtgaggtttgagtccttgaacattgagcttttctactcagacagactcgtgtcttcacaaacaatcaagcctttcactcaaaggccaagggaaaccaggttgcaatcagtgaacttgatatcaagcttggtgtttttgccgcaagatgttggtgtaaaacttcaaaggcaagtggagaataacagggtcaattacaatgcaaggggaacatttaaggtgaggttccatattggccttatccatttatcttactctctgtatagcacatgccagatagagatgactagtcctccagctggtattctagtagccagacaatgcataacaaaccgatgatgaagagccaacaaacatgatagaattctttgtggtttcttattattttctagttttctactttattaattaggagatatagctaatggtaaataccagtgtgcaaaacagtgatatgattttttttgtgagaaatgaaaaagagaatattagaggatatatatatatatatatatacacaccatatgattttaattttgatattttattgtttttatttgtagatagagacttgggtggaggggtgttgaagcccttccataccagaatatgttgtgggtggagtttttattttatcttcatctactagtttgttttccagaacgcgcttttgctgaattaactttctgatactgttttcttttatttccttaattgtgtcgtgtcagctgcactaattggaatgccttttgactgttaaaagcagaaaaggacttgtcagaggttgatcattgcgtggtatcaactaagatttcaaaagtatacatacataattttattgtggtgagccttacatgagttacatcccaaaaccatgtcttaatcagaatcttcatatatatgttcgctcaaaggccactaaagcatatgcggaatatccattgctattttctttttatacaaaacggaatatacttgtattgttagtgaccatgaccagttacccaccaagacattactattatttcaggttaacaccacaacggattttgagctatcaaaatagaattttgtagaaaattaattatatgaattctctgaagctaaaccattaatttatagtaggtgcagagtgcagagtgcagacagtaactcggcggtacaatgataattgatgaatgtccatttaagcatatatttttttctttttttttttttaattccttttgttctagcttctgctaagaatgtgcgacggggaaaagtatggccctgtatgggagctattactatacggattacggactaatatgatagactgctttgtatatcatcctgtgttaagtaatttcacattttataaagtataatataatatattactgaacaggaatcacggattggcgttcaactacagagaaacaaacacacttttataagcctaatccttatagttcttggcatatacaacctctcagaagccaacccacttccgcttccaccaacatacttccccagagtagcctcggaattggtaatgttactctgtcacacttaaaaggttggcatgcctatgtttcttctcaaatgccataaccaacctaactatatcgatcccatatcctgtaaccaccagtttatctctatctgctccatttagcgacactgacttcacacctgcgcatccatgcatgcttcccactgttagcttaaccaaccaagtacatgtatacctagatattcttggtcataacataaatattcatggtgtaattaataataagccaagcaagttattttaattaataaaacaaaataaaggtaccctttgtcactgccgcaattttgagggccttccttctgcatccatcacagtccatttgcacctgtataactatgttttggtgtaaggtaaatttaggcctacgaaaccagtatctccagatttgatacttgttgattgcgacctcacgaccatgaacaacaccaatcctgttgtcaagtgagaaattggtggtggctgcttgaagctcagtttggctgaataattgcgcagcagcagcaacatgtcctggctcagcaaaactatggacaggggatgctccaaaatcagatccactagcactactactccttatcgcactgtccactagctcagcaaaactatggacaggggatgctccaacatctgacccactagcactactactccttatcgaattgtccactagctcagcaaaacttattacatcggccatgtcaagtgaaactgtgattgtggtttggcggaggcgtggaaatctactgctctattatgacacatataaacgcgtattttttgagatgagaaggtgcgaggcaaggcaaaagaattggatcagatgagaaacacttgtgtggacacaaccccaaatatcagaaaagccggcttggttgaaccgactttctttttatattgtcgtgttagctgcactaaaataatctcttaatccagaatcttcctagctgttatttactacgttagtttttcttatttttttttttcaaagcaggcatttgaatcctgcaccacccattttgatgatgctttcggggttcagtgaggagggtgcagccgtgcagggacttcgaaaggtacaaaggaaggagggtgaaggagggctttgcaaagctgttgtcacacttttcgaggtttgggaggtgttaggttgggtgtaggagccaatgaggtgttagggttggggaagggaggtggtctcgttaaggctaatttggtctttatcgaattgcttggaaggtgcatttagaattcaaataagggagtgtaggattcatatgtccataacacaatggacataggtcgggcaacaagatccttcaacataaataacaagcaaaggacactgaagcaattaataagttgttagtgtaaacatttggatttgatttcttaagtaaagtgttagtttaaattttgtggataaaaaaaatatagttagaaaaaaaaattctactaaagtgatcaattagatttttttgacaaaaattaatcaattaatttaataataattcccacctatgttaatatatgaaagaaaatgtctctaaagtgagccaaatatttatatatagagagagacacacacaaacggtaatttccttgtatagctagtgactaatgactcaccgagacattactattatccatggttaacaccacagcggattttgagctatcaaatataatttgtagaaaattaattatctgaattctctgaagctaaatcattaatttgtaataggtgcagacagtaactaggttgtacaatgataattgataaatgtccatttaagcaaatattcttttgttttctttgattcttttctttctagttttttttcttccttcaaattccttttgttctacctgctgctaaagaatgttcgacgggtaaaaaaagtacacgcccattattacatcatttacatggactaatataattgactgctttccatcatcctgtgttaagtaattgcacattttataaagtacaatattactgtttctgacaatatataccagcctccctccaacaattatttttgagtggtacgcgccatcaccatttgacattaaaattggctcctataacataataactgatatttgtaaaaatatgtaacccaaaaataagcatgttaatcagaagcaaatgcttcttaggctgtatcatacatatgccagaatgcacccaccccaaatcagtccccaagtccatttagagtatgtttgtttctccattgtcatgctttcttatagacctcaacgtgactgaaccaaaagcatggattgacgtttttaaggtttttaaaaggagaaacaaacacactcatagaagtctaatacttgtagttcttgacatacaaactctcagaagtcaacccacttccgcttccaccaacatactttcccagagtagcatcagaattggccttgcatcttgccagaaatgcctcttgagctttggcaacattctccttctttccaccccatgtcttgagtgtgctttgttgcagtgctcgcccgaatgagaatgagagagtccatggcttcaacacctccaacttgttcattgcattcaggttgagggtggcttcttcttcactttgcccaccagacagaaacacaacccctggcactgcagctgggacagtcctgcggagggcttgaactgtgtactcagcaatcacctcaggtgatacctgcatgcacacaaattaaattatttttctagttaataatatgtaatttttttttcttcctaaaagtggtagaactggaagaccagtagtttcacctaattgcaactacttaactagcctctaagctccaagagagcttcctgaagaaggttgcacaccaagcaagaaagtggcatcaaggaaatttgaatccatacctatgtggaaggtgagagttcgaactgaccagattcttaactactggtgccaactcacattcgcttccaagtaaatcgaacaatgatatttagacacccttaaattactaatgctccaccaacaccaatcatttctcttttcctatcacatcatatcattcatcatacctctactattcctttatctgtgtcaaatagcatataaggtgtccacaaatcttttttgaagtcaacaatattgcaccatacttcattccaattttatttctaagactagtaagtattcaactatagaatgtaaccatacatatggatgtatgattttgaaaatgttaagttacctttgggctatcagagccgggagtaaccatgttgggcttgagaagagttccttcaagaaggacatgctgctcattcagtgccttgtaaacagctgcaagtacagtttcagtaacagcagcacatttggcgatgtcatgagccccatcagtcaaaatctcaggctcaacaatgggtacaaggccattctcctggcaaatgatggcatagcgtgccaagccctgtgcattttgctggatggaaagctcagagggctcagttgggccaattttgaggactgcacgccacttggcgaagcgtgcaccagccttgtagtactgttggcaccgagctccgagagagtcgaagccctgagtggtggtttcaccatttgtgccagccaactcaacaacacccttgtccactttgatacctgggatgacattgttctcttgaagtacctcaacaaaaggcttcccatcagagcttttctggtaaagagtttcctcaaagaggatgacaccagaaaggtattggagggcatctggagcggtgaagagaagctcgcgaagagcttggcggttcgcctcaatgttctcaacgttaatgctcgataggcgcttcccaatggtgccagtgctctcatctgctgccaagatgcccttcccaggtgtggctatgtacttggcattcttgataagctcatctggaattgatgtaagttataacatacatcccatttggaaaccaaagtctaagagttgtaaacatataaagatttagaatgagcttcttagacatgaatgaatcttttataatttgatattatgttccaataactaatgagaatatgatgcatttctcggctactcttttcttgttaatcagtacattaaagtggaatgtttgacaagcttgtacttcattcaatgaagaattgttcttgtttacgtgtgggtgagagatgtgagtaatattaagagaagaggaggagatatgagatactacctgcgtactttccaacaaaggcagacatggttaaagcttattggatatatggcgggaaacagataacagacgacagcacgaaaaaggagtttagccagaccaaagctatatagataaaaatctcaaaggaatataccaagtggtattctacccaacccatgcaaaggaaccacgtgtccagtgattagcctaacgaaggttatcactcttggataaagcaacgagtgatccttcccttgcccaagtggcacctcatccgtttcaataatatatattccactcaactcatgatatataacaaggaaattttgtggaaagctctcacccgtcatcctcttggacttggctttacatattaagatatcaacctaaaggctcttatgaaaattgtttgcagaacaatgtctcagtcacattatttatttttatttttttgtctttttttcagaatcaagttccatcctcaagttacatctttatgcaatttaccctcgctatatattctcaattttgagagtgatagatatttaattaaagaacttacatactcatttatatctatgaagtaaaaatctccggacagtaaaaatgtatcttgataagccagtgtccggcaaagaataagttcaaagaaaaattctggtataataataaaaggtaaatcaaaatttgcattggaatattccgattatgcgtatgtttgtaaaatcaaacaaaagattatgatcaaaattgattttgaacaataactcggagaccagcagaatcttaattcagcaaattttattgcccccttccgcagtaaaagtctcattaatgatgacgaaccaaaaaatattgtgaatttcctcccaagtataactactgtgaagggggtaccaccttctggtcatcattatctgttccaaagtaccggtccccaaactcacccatgccaggtatgacacggaaatcttcattcaaaccaatctcaatctcagatgtcaggatttttattctcggaaatcttttacagaccacatgaacaccttgaggtgcctggcaatatgagagcatatatatatatatatatgcaaatcattaggtacaagaaaagaaagaagcaacagaaaataacaaagaaatggcaagatatatatgatatacagaggaacaacaacaggcacaagtaacttactgatacgagattgagaaatataatgttggactctggtacacccttctttaaaagcaaagaaattgcttgaacagctgaattacctaaagacgaagatattctaaagttaatcaaaatgaaaacaaacaaattaaatatcaatttttttatatacccttattatgctaactgctatgtaacttaagtcgcagttggctactgacggtttgtatattattttaaaccagtaacataaaaaacaccataaaaataaacattatgagaatgacaaacctgtgcctaagatgggatccagcagtaatacatgcctatctgagatgtcattaggcaacttctcatatattagctgctcaataatcaaaggacaagttagtgaatcaccaaaaaaaaaaaaggataagttagtgatcatgaaatgaatcaaaacagtatacccaagcacacgcaaatgacaaacctgttgaccgttgtcaccttctctatgaataagaattttcccaatcttgatacctttgcagcatgctcgtaaagcattttccatactctccccactgaaattagattgcatatcaaatttaaggacaaattctatttataaaaaattgcagtgatcataggttcacatcaaactgagtaattaggaaagaagaactagtttcttagaatatagagaggggggttggataatattttcaaggataacaagtagagtaccatatgcaatctaaacaatttggtaattataaacccaaatcaacaatagatctttctctttattgaattgttcaagaaagtattttagtcaaaactttgtagcaaggataacaatatttaaacaaatgcccaagtgacttctgatctggactaaaacgatacctccggatgatggagacaccacacaacctcttacagaaatccaccccgctgtataccgatcctgcattgaaggacaagtattagcttagctgtaaccataaaaaggttaagacgtgaaacaaactaattctattttgtaaatatttgaaggagaatatcagcaaagatgcagacaggaaagttaatcattttcagtatggcaatcgcagaaattaacatcatgaacagaacatgtctctctactgtaaaataacatgatatccctttggttcccattatatgaagcatttcttagattgggaattcagacagcagaagttattcgtagtccttccaacttggctgaattatgtctaactatgtcttggataacttggaagtttcaagtggtctaagacatagacaattctaaaacaaggctggaaacatgtagttcatgttactcctcatttttgtgacaataatatggcaggattttagaaaccagagatacccaacaggcacatcatccacaacactttctagtgcaatgagaagagaatattgcatccttagttgcacataaaatacaagtaaaggcgaccatcattgaaaaagaacagcttaccagttggagtcgttacttgcttttctgtaaatggaagatgccctaggccatgttctacaacctggtcaagtgggcgaaatttgaccattaatgcttgaagaaaatgccatgccatcactaatattaagagcaacaaatgaaccccatttacataccaaacgaatcagacggtcagaataaaatacaaagtcatgtttcgttgtttgagaatcacgtatcagagtatgcataccccgtatctgcatcgaagcaattattgtgattattcaacttttaatataaaaaaattgaatttggatgttccagatgaacggggaaagatgggatgattgataaagacgataaataacaagaaaggggtacctgaaaagtagactgaatgacgtataaattaggatatattttacacaagtcatgctgaccaagcttcgtgcgaatatgttgtacaatcaagtcaatagccacatgattatctcctccatggggtataatgatatcagcatacttcttggtgggaagaataaagtcatcaaaagccggcttcacaaatttagaatactgcatcaagtatatattataagaaacagttactaatatatggtaaacataaaaaaaggaaatatgttagcttgatttataatcataaccttaaaacagatcattaaagatttaatttcataaaaactgacttcttacatgttttctaatcaatgaaatttcataacagcctctcagcaacatgaactaaaataacatttccaagtcttgaaatgcagtacaagtaagaaacgtgaaagcaaaaaaaccagaagataatcaaaatatgataatggaagtgcaaatggtgtggctgacggtagctacctgatcaagcacagctccaatttcacgagcattgtcagcagtatcacgcttaattcttctagccagacgaacatcggcatctgcactgaacatttcacaatgtaaagtgatagcataacttagtagtgcaacaacgagatataaaatatgcatgcttgtaaatagttagaaggaagacgtaggcaattattaataaaatagaaaccaacaaataaatgtggggaaaaaaagatgaagatagtgtcattagcataacttgaatatgcgttctcctatatcataatgtggattaggaggggggaaatttaagtccatggggctaaaaggaaaatgaatctgacaacagatccatatatagtaagaaatgccgcagaaaaatacaatacagtaagttataaaagttatattggaacttaaataataagggacctgtgtcaacaaatatcttcatattcatcaatgcccgcactcgtggatcatggaaaacaaggataccttccaaaataataacatccgctgggtttacctgcaaaacacattaaaccaacattttttttttttgatcggcaaacattaaaccaacataaaagggaagtatggctgaaattgtattccatataatttcccctctaatggagataaaacgcaagaagaaacatgtactgcatgatttggcaatcattagtacatcaaagtattcatattcaactacgaaaatcattgtcatctcaagcctatgcaataaaaaactattctttagcatgataataaaaactcaaaatagaaaattataatcttggcctgttctgttatgcatttcaagaacgaggagtaaagttactactaaaaagttgaatgttccatatacccgtcttgctggaaaaacatcattcttgtaacccttaaagtcatactttggaatatctactgcttggctgtgcttcaacttgtccatgacacgtagcaattgctcagtatcaaaagcttctgatgacatcaacaacatacattaggaataaagtagctatagcagtctaagaaccattattcacatatataaaaaaatttaaacgttaaaatttccatatcaaaagttgctaccttatcagtttttaggtgtattatactaattatgcttgctaggtactcaagtatcgtaccatacaaaatgaacttttgttcaacctttggaatggctcataatgcatataacacaatttgtaacactctgacatgtaaaatttgcagtggtctcaccaaccatactcatctctaggctaaatgcgagaatattctagctctggaatttcattaacactttcatgtccctaatcagttaattttgaggtaaattctgctttacatctttcaaaggttaatttttccctgacaccacccttgatattcctgaagcattctgagagtaagaaagatggagttgatactaattgaatgtattgaacttgttttgcaagaaatttaagtatctacgtaaaaacataagacctgataaaaacaaaacaatactaaaacgtgaatattattttaggctttctaacccgatcctcgaaaagcattttaggaaaaacagaactccagatataggagaataagtagatttaaaataaaggaaataaaacaagcatccgaataaatttagtgcatgtttcatcctgtataatttcttctctctctctttattttttatttataaaaggacccaagacaaggcctaaacaataaaaacaagactatctaaagaaggattttgatgtagctccggacttttttatccaatcctctcctgagtgatgatgctatataatgtcttaatgtaaagagaaagttactgattaataatgagagactaatgggtacaattgaactgaccaggatggtcaaagttgtaatcttgtactcttgtaagttcctcctcagtcaaattatggtaaaaagaatcctgttgtacaataaataattcatttattacgctcaacgtatcatcatgtacaataagaaacatcaacccaaattctggaacacataccctcaaaaaagataaaagaaggccaaagtacaaagggaacaagtaaaatatgtaataaataaataaaaggttaagggcatctccttcaagcaagtcacacgagttgctattactttataatttttcacttcctcgctgacataatgttttatggctttaataattcaataaaaaatttctccaatctatcaactctaaaaagtaggctccacaattgatcttgctcttttatattttattattcatcttaattttaatttaaaatatttttatgtcatttgttttagtaagaaataaatatataataatttttaattccataaaatgttcacttccaaataactttgcattaatttttaattaattaatttttagaatacatggaaaatactatgtactaataatttaaataaatcaaatcaattataaattaataatatttttaatgtgaaaaaatataaagtaatatattatgaaaacatagtttaatttataaacaatacaaaaatctaagttatttgttaattaaataatttttaaaaaatctaatattttaatatataaaattaattaaagtccattaaaaagtagaaaactctagttgctttatatagtaacggtgctttatttgtaacccatgaaaattgctctccaacatccgaagaataagactcaagttactagacacttctaatgccaaaagagcaattccattgaagatggcttaacagcataaatgttagaaaatacatccaaagaattttttacttttgtcaactaaaaaatggtgtattcaaatgtgttctgttgttgagaaaatcattgacatttggatggaaattttgagggagaaacacatacatgttcatgataaaagaggtgattagaacaacataatacagaatctgacttgaaaaagaaagaggtggagaaattttggtgaatggtagccaatagaatgtcaatgttgcaatgaaaatacaaaacaaagatgataaaatcattccaatagataaggccgaacaaaataccaaggggattcagataatggaggatacaggatgcttataaggcttgaagcattaaccgcaaactattagttgtattcccttaatatctgactcacagactcatatagttataaattctcaatttgatcaccattcaccagtacgtttagaaaaaatcaatggttattacaagcatacagatgctctctctttcatattattttcactttatttttttctcttttctacctcatcatttattacatttactttctcttttatctttcttttttcttctaatctcttcctacgatttcaatctacaccaaaatgagataaatgattggtactttgcaagaattagatacctgattaacaagtacaactcgttggtcatgaagctgctgaacaatcatatcacaaactgatgtcttaccggatgctgctccaccagcaacacctgtgacatacccaaaccaaaaagtaaatagaaaatgaattagaaccgtagataccaaataaaagttggttagatgtgaaattaagacatacaaagttgttacgatcttattttcaaaactcgtgcgtctaaactttgaaacaaagaaaacttcaatgttaagtatgtaagtttgcgggaagctctacttttatattattaggggttagctgtgtgagttaaccacaatttccaactgtaggatgaccaagtaagaggaatgatcagctgaaatgaaattgtgatgcaagaacgtggactagatcctatgtggttcaacttctccgtaagtacttatgaaagaaaaaatgaaataaaattttctcataagataaaattaatttatgcccaagttaaaattagtttttagagaagataaaataaattgtgaagtatgatagtcttcaaaggtaactttgttcttcttcacttaaaaactaatggctcaatggaatcatatgcaaatgcggggaggaaaaagaaagctgctgagatttctctgccataacagaacagcaaaatccacatatgggctctagaacctcagtttatatcatcccaaaaacttaatatatttagtaccctattatacattagatgatacccaacaaacacaagacaaagtaaatgtaccaagtaccaacattgatttatagacaaatcaggaatttatgactacataggcagcttggaatgcaaaaacacacacctatcacgaaaggttgtttatacatgtcagttgctgaagtggttggttgctctgtgccagcctttctttgctctaagccatccatgtgaaatccagaaaaatgaacctcggataaagactccattaagtcaacaactgatttagtacccataggcaatgacctggataaataatacctgaaaatcacagatagagaaatcaataacatacaaatactactcaataaaagaatatgaataacaatagttttaacagcttgcaaatttggctgattggatcaagccaaccatttcactctttggtaatgttactaattttcactaaaagactagccagtagaacaatgctcaagacggattcaccctttaggaggcatcatttgtcatcaagttcacttcaggaattataaggttagctttgtggttaaagggagaattcacagaagttgttaattcgaagtcctttccaaactctcactaatatactaataaaactaacaactaacatttattgattaaaaaaaaaaaaaaaaaaaatcacttcctaaagccatctagatatataccaagggcttttttagtcaataaaaccaaagtgttaatctaaattcctcaagtaatggacaaaacaattaatttccaatctcattctctccacgccatgatctatcaaatcaaattaatcaggacatcatcgacatatacatgacacgcttccatccgatccgatgaacaaaagacatgatatcatcaccatgcggtgcacgtaacaatccatccaaccagagtcagtgagaggttatatttgcgtgcgaagtgcaaagtgcaaagaaacagataaattaaaactggttcagttccaacgtgagcgaattagcgcagccattgcactaaagacagggatagcagtgatgaatgaatgaatgcagtttaaagttaagaaatccagatccagttaaatgaggagaggagacgagaagatcaaataaccaaatgctgaacgatggcaaaacgtacctgatgaactcagaattgtacgaaatagagaaagaggaacggagcgaaagaaagaaagaaaaagggaaaatgtatagtgacagacagatatgatgctatttggtgcactatcagacgctgcctatttacccttttctcttagtttatatatatagtgacgtccaatgaggcaatgagctataaacagaccttgatcttcaggggatcttcaaattaccaccttcttccatcctgaattgaaactactacactgcttcacccaaaagcatgcgctacgttggacaaatcatttaagctattttttttttactaactaaatacttattttttaaataatttctaaatttttttaagtaatttttaatattttttaaaatactatttgaaataatatttttttaaatgctaacttctagcatattttatatatatatatatatatattatctttaacatatttattcaatttttttattatcctttttagaaatgttattttacatttttaaattacttcaataattaatttgattaaacacttataatttaataagttagtttataagtcttcaatttttaactataactaattttccaattttctaactttcaactaacttttcagctaattttgtcaaatataatcaatataaacaagtgctaatgtccaaagtttatttaaaactattgatcgatttcattaatgtgttcataatgcaaatgaaaaaaaatattaaatgtcttattaaatataaggattaattgcattttttatcctgcagggtaattgtgtaattttggtttataggttttagttgcacaaattgagtcacaagtattctccaaagaatataattaaattcgtgaaacaaacactccctaataaattttggtacggtagcacataagttgacgatgataatgtgaagtgacaattaacatattgtcttacacttatattaacatagcttagttatacttctagtctatcaagccttataattgtgagagattaaaaatgcataagtcatattaacatatgtgttagacaatatatcaattatcacgtcaatgttatgcaacacattctattaaaaatatgttatcttttttattaatatgtgaggcctttttaatttataaaactaataaaaaaattgccagtaggtcaaaagcttgagttctagttattttactttggtttaggtacaatacctagaaaatcaaaagtgcaattaagtttttaaacaaatgatcaacaagcaatgggttaagttaagtggtgatggatttatattccttgagcaagtaactaagggagtaagggctcaaattttaatttttgtgcataaagaaaatcaagtcaaaaatggcaacttacctttaaaacctttagctcttcaaagaatattaatcttcttataatctataatttcagttttttaataaaataatttgtttctaaaataagtttgtttgtttgggatcctagcttaaatttagaagaagaaaaaattgaagaaaaaaaaaaagatgtttttacagcttattttctgtttcggctatttttatactattttattacgtaaaagctaatcttttgttgcattcaaaaatatcaattatttttaaatcacttttcaacaaacttactcaaataaaaattgatcatgattatgattgattatacaaataattaactaaacatataattgattattcaaatagtctaatttttaccattatttcaaacacatctaaaatactccttataataccaacaaatcgttgatgcaaatatttttgtattcggtcaccataaataaggtgtcagatttgaactttgtgaataaaaaaatatttttaagagaaaaaatcctattaaagtgatcaatcagatttttcgataaaaattagtcattatcaaaattgatagatatttcacaccaatatcataattaaaaaaaatactcctcacaaccataagtgtatttttttaaaaatgaaataaataaatcatggaataccatatttttatataataatttttaaaatatattttttttaatttcttagaacaatgtgtaggaacacgtattggaaattggtagagattagagaaacggaaaatcagatagtatacgtagcgtatgggtatggaagtggtagagggacagggacaggggagtgtggagtgggtacgtgtggtgtggttaatgacttaatgtgtctatgtttcagtgtggaaatgtcactcactagactgtcatctgtttgggggccccacgcccgcagtatctaatattttgagcatccaccttgacactgaatctcatgtcgggcctaatgccttttcctccttttctacacctttcattatttttaaacaataattattttaaattcatttctgataatatgaatttaattagattagatttattcatatttaataatttacacatttttttaatatgtcatttaatatatgacctccttttttatattattataatttaatttattcttactttaaactaactaaatacattaatattttattcttattaaatatttcttaatctaggttaatatacgagacatcgaccaacgtgtcacattttttaaaaaaattcatccaaatgtcacgcgaacagtagtatttcccatactgtcacgctacctatttgatccaaggcccaacgaaataagtagctgatgtggtgcaattttgtttgtcatgtacttcgctataaaggctagcgaaatacgcggtcaacaacgggtaggacacgtggcagacactacgtatttcgctagagccaaacaaaatatgtggcattggaacacgtgtcacgcatgcatgaattggtggtgatattgattatataaacttcaaacggtcataacttttgatagaaacgtctgattgaggcgtacgatatgttaaaacgctcgaaatttataagagaaggtctagacaaattccctaaagggatttggtcaactatttttttcctccaaaaaacgcctctcagtatgtgaaaattaggatttaggattcaatcatccaaaaaattccttttttctacttttttaattatttaattagttaatttaatgctatttttatttttttaattacttcttttaatttcgagcattttgacatatcgtacatctcgatcggacatttctatcaaaagttagaccatttgaaatttatataattaatatcaccaccaattcatgcatgcgtgacacatgttccaacgtttttttttttttttcgttgtcacgtatttctcttggcccccagcgaaatacgcggccaacaaaattgtgccacatcagctacttatttcgctgggccttatagtgaaataggtggcgtgacagtatgaaaaatactattattcgcgtgacatttgggtaaatttttttaaaattgtgacacgctaatcgatgtctcgtatattaatcgtaaatatcaataattttacagaaaaaaaatatactttttatggacttaaatataagaaaggacctctcaaaaaaaatatttaagaaaggaatgtccaatttaatgaactgaattatagcaaaataatatttttcatcgacttaatatcaactaatttaatcttatttaagttattattataagaatattcttaattcaattaaaatgtaaaagttatcttccattaatatgattaaaagtagttaaaaaatgtagttctttttttaaatgaaattaactaacaactttaaatagtataaaattattaattttgtttccatttgaatttagaggaagtgagtgttaaagatgattaatttttttctaattgtgtttgaaaaataatttcttatgcaaaataaaacttacttcagtgatatctaaattttaaaagaaatgaattactttttaactatcagaatatccattgtgcaaacatatatatatatatatatatatatatatatatagtaaatagtgtataaagtatgctctcacgacaacacaaagggactaattaatattgagactaaatgattatagtaaatagtgtattaatgtatgctctcacaatataaagggactaattgagaccaaatggttcaaaggagagaaaggattttaatgaagagagaaagaggagagggattttaattagacattttgtttgggtgagacaatgggagaagaaaggttttaataaaggaaggagatcaatgtagcctttttttttatttggttcataagagagtatgaaattttaaagattaatttactttcgtacagttatgattttaagtttaaaacgttgggatagtttacgtcttaggacactttaaattatttaaattctctcttcatcccttcaaatccttcgttagaagggtgcaaaaattagatacttcatttttttccattctcttatattgttcccaaccagtgaaggagattttacattattgttaattatgaactgcacattaaatttgttaacttttatattaataatcttaaaaatcatatttatgatgatttttaattcattggtaatgtaaaaaatttaagactaactatacatcaaaattaatttttttataataagcattttaagtgtcatttttaattagttaatagaatgaaaaattaaattaatcaaaattaaacttattaattgtataaaaaaaattaataaacatccgtagccagtataattattttatatcatcaaataataaaaaatatttttttatgactcttaaggtaattattaaaaatcaataaattacatatagtaatttgttattgaatataatgtaaaagattgtactattatttgtgaatatattatttattcataaaaaattaaatatgtgtatttaatattctaattgaattttgtatacaatattaagaaaataaaagaattgttaatttgtaatttgtttgttataaaataaatatgacattattcttgatgtacgtcatgtcgtttccgtcttacttctcattttacccgtctccacttgggtcccactaattgtcatccacgtctcgggcctgattcacagtgattcaatcatgccttgaaaatcgaaattgttgaaatcgagagtattctcttgtgtttaacactttaactatactattaaatcaaatgatcaattattgtattagtcaaataattataaggcatgattattttaatggagtactactattatctctggtcttatggacagtgtaagcaacagattgatattatctttcgtcctaattataaaaaaattattattttaaatcctctaaaaataattaattttaaatttatttagagttaactttcatctatatccttaatttattattaatttcgtttactagatattcattcattaaattatgaatactgatattaaatgtgattattacttacaacattcaaatttaaaagaatttttataataaaatttgaatctatgataacattaaatgtgagtttttatttattttattttaatgattcatcatatgtttcttatatatagaattagagataatatcattttatgattttaattaatttcattcaattatttatgtaatattttcttttaatttatgaattttcttttccttttaaaataagtacatgtattttataagtttccctttattaagattttttgtatttaaaaaatattaatattttattttattcatactttatatttattaagtttgataataaaaatatcaataaagtaaaattatggaaaagataagttgtaatattttcatatttatgtaaaaaaaaggtgattccacaataattagtaatatggctaaattaaaatatataagtaaaaaataacttacatttaagagtcaattttgtacaattgagttagactgaaacttcaattgtaagatgatatgtaagtttatcccaatgattatcgttggacttattgagtcattcactagtgagtcattattagaccaattacaaatgttaaatcatgcaaatattacatttgagatgtttagtcttctacatgagaaaagatgcttgagatctcatcaactaataatattgacaaataaaagtatataagtggaagagtaaccttcacctcataagttgattttgtagaattgagttagatcaaatcttgaattataaaaaaatattaataaatgttaaaattggttatgatgcctcttgcgcctccatgcatgagcaacctggctcaacaatgtagtcaagctttgtatcattagccatggcagcttgtcactcttattgtgttgccatagccttatgtctacaaattgaagctctcagtggtactcgttcaacttgggatggatttggcatgtcctccctagagcccacttgacctatgtgtccaatataagatgtacacaacataacaaacctgcaaatcaatataaatttaataaacatataaaaacatacattgatttccaagtacacaagtaaaacttatttatgttgtgtatttgattaggtacatgacataaacttatttttgttgtgcgcctcatttaggtatataacgaaaacaagttccatcaaatctttaagacggaaaaaaggagcttgaaatgctctcttgtgaagtcacaatcaatggagtttaaaacactttgattcaacaaagttagagtgtgatggagagaaagttcaatgggggaagagagggattggaaaagggggcgtgacaccaaaaacaataaaggggtcaagaaggtagaagaaaaactaagaagtgagggaaagggggtgaagggtgttctaactaaggtgtgtcttgaggggtacgaaggaataagggtatatgcatctttttaatgtattgtggtaaatagtaattgagagggtgccaatagttatgtccttaggagaataagcccacaggtcataattgaattaaatagtttcttgtgcttaggtgctaatttgaacattttctctaacaaatattgcaccaggaatatgttattggacctgaaatgtttataagcagggattaactttctacaccattcatttttccaatacacccaacatgcacagtgtaataccaattttacccttctcataacccgtaagttgcataccaacatacaccattcgatttcatacggatcgacaatccgtaagagtcatacggatcgacaatccgtaagagtcatacggattgacaatccatatgactcttacggatcaacaatccgtatgagtcatatggattgccaatccatatgattcatacggatcggcaatccgcaagagtcatatggattgtcaatccgtatggaccttacggattgccaatctgtaaaatcaatatggattgccaatccgtcagcttcctccgtcagtgcttgagttgcagagcttacctccgacggcgaaccggccaacgcaacctccaccaacactagccacgacctccacaaccagctcaacaatgcaagacgcacccaacagccaacaacagcacgcaggagaagaaaaccaccggaaaaagaagaagaatggcgaaaaggtgaggctggtgtatgttaaaaatcaccaagaactttattgtcatttatgaaaaatggtgggtgtatggaaaatttgcctggtatgagaagttaaacccttataagcatcatgtatcaaatgctccaacccaagatggtcattctagaataacaaaaataaataattttatggacccaaaagcaaaacattaaatgtcttcaaggatattcaaaaacaaaataaaaaaaaatatatagtaaaaatatatttttgtctgacagtactttaaacaagaaaactttaaaaaaatatctgccactaaacaaaataaaaacaatacttctttgaaatttttcttgaaaaaagtggtggaatgtggacggaccgacagacctggtgtctcaatggaaaatactttattcgttgtttaaagatttttgtaattagttttcttaatttaatgtattttttaattactttagttaattagcaaaatattttgctctttaataaaaaaatgaattcttattttttttaaaaagaaataaatggcttaagctattgttttatttttatataaataaaaaataaacagaataatatgaattgttttatgtgacttaaaacaatgaactaagattagagggtttgcatccgagatcaccatgaaagagttgttgctactcgaactaattttagaggcccatgtctaacatttgcagaaggagaagcgtgggcactattaaaaagattagagaaattaataaaaaaacggtaaaaaatagataatttaaacatcacaataaaaggacggaactaaataattagagaagttaaacaatgataataaataataaaaacatgaaaataataaattaaatttaaattatacaataatacttgtacaaaaatctaatttatatgtaaatagataaaataaataaaaaagcaagcatctaccctatctaaattggggaatcaacgttcggaaaaatgtttgaattttggaacattttggctctcatgtttctttccacatctaacgcatgtcctggatagaatatagttttatcatatgcctttattcccgtcaacaatgggtcccgtaatctctcttggctatgaatttttatttttaactgtggtaagttacagaaataaactaaatttaactgtggtaagttgacaacaggccacagttgccataatctctcttttcaattatattttttcttcttccatttgtaagattgaaacccaagtgttaattgtgtctatttctttttaaaacaaaaacaaaactcataaaagttaaaagaaagcaaattttggggagcaaaaaagttatgaaaggcacaaacaatattggtacgacgtcattcagggcgaatcgtgccgttcggtgggtcccacagaggaccacagttgccacctaatcagacgccacatcggatacatacgccgttaagacgttgtgatcccccgaggacacgggagtgacggagacaccaacgttcaaaatgcaagttcaagtttaaggttgtttttgttttgttttaagttctctttctttctgtttctctctcaactctcaacacattcaaaccaagcatttaatataagcctcttcgcattttttaacgctcattcatcatcaaatcaaatccacgagaaccctgtttctcctcacgcttctgcctcagatccaatcttcataacccaaagcttcactttcccaggtattttaaatgccaagttctttttaaacccaaaacaatttgaattttatttttcggtggttggattctaatagtatattaagaactgcattgaagcatttctccaattgttggtgttgcaggaaacatgccacaggaaaccttaccaaactctaatttcatatctcctcttaagagaggattgaatttgaaaggttcggcggcttcagcatgtaacaacaatgagactttacacagtttgacggaggataccatcaacgatcatgaattggctcagagaaaagcagaggaagcaggtatcaactttgattacgattatgtcattgcacattagcactgttctcttgttacactcgctatgtgttcgtaattgtcacctaatgcttcatcacaaataaactatgagttgggaacttagattttatcaggtagtactttttaatatttgtattctgaaaacaatatctttgagagcataggaatttaaggttgtcccccaagattgaaccaaaacaggggagtaagaacttagttttagagctcactgaaactagaaagcactgatactatctgtgtttaatttgaagtagttaataatatttcttctaaaaaaaaaaatccaaagacccatttaggaataatgaacaagtgatacttatactaatactccgcaaaaaaagacttaatcttctgttaagattaaataatgaaacatgcttattgcttgaattcaggcacatttcttggaaaagtttcattatttgaacataaatatctttactactctttttttttttttaataatatttttcatatatactcattttaaaaatataccctataattaaaaaaacacccttaaataaaagagaacaacgttttattgtttcacaataatgtttctctttttttttttggcattataataatgtttctttatagtcatagaaaaagtttcttttgttttttccccatttcctctggttttcttagcgaaattgatttgtttcttacattttcttttctattctatctactaaattattacttgcacttgcacattattgctttgtttaagaaaagggaaaagggaaaaaagtattgtataaaaaaacaaagacaaataatgaataattattgtaactagattaaacgaagtgaggctggaaaagagaaaaagaaagggacagaggacaaatgaaaagatcgtggagcacaaaattatatgcaatgcctggggatgtgttgtgttgctctaaaatgggatcactcccccagcacaccagcattcaatggtggcgtgggtctttgacgttgttattcaaattttgtgatttaagcctggtcgtttaaatacatgtcaactattaatttaagaactagtactgcttgaaattcagatttaaaaacccaccaaaatcttgttctattggtgggataacatttttctttcactgccgaatgtaactgactttagtttaggtttatctatttttaatttttcggtaattatttatgtaaaactttaaatcaagaatgtttaatattttcttttaaatttataaccctattttaaaagtaattttatatggtattcaaataaagtcaagttaatacagtagtatttattacactactttacaattaattattcttttcaaaaagtaatatggcctaatttcaaacaggaaacaccatgattttggtacccatttaatgcaacactgctgtaaataacaatcgtgactagactactttaactttaacctttgattaattaaaattcaaactttggcctttgtttaatcagaattcacaaatataaaagcataacagtaaacgacatttcttgagagaatattgtttttttgggtaacatttcttgagtatgaaatgagagtagacatgttaaatttatttatttactcttatgaatcaccattatacctcctcaaagaaatttaacgcaagtttgacatgattttttttataaaaggaatagcgttacttttcaattttaaaattcttttaatgaaattttgattgaaagactatcactagggttgttctaatattgttgtaaaaaaaaagttgttctaaaatgtgaaaattgggaagtgtgtacaagattttaagttataattttgttttttttattataaaataattcacaacatttatctagcacatctgaataaaccatcaattctcttcttaaaaaaaatcttgtgttattgtaaaaaaaataaaaaagtgtgcatgaaacggcggcgtatagacaattggacattacccgccatgtctttgttgttagttgttcaaatgttgtttgtttgtgcttgtgagatcagcttcaaggaggtacgtagcagcagaatggcttcggcaaatggacaatggcgcatcttcatcactctccaaagaaccctccgaagaggaattctgcctcgcactccgcaacggtctcattctctgcaacgtcctcaacagagtcaaccccggcgctgtcgtcaaggttgtcgacaatgcggtggtcgacgacgtcgccgttcagtcttctgagggacccgcccagtccgcaattcagtatttcgagaacatgcgaaactttctcgaagccgtcaacgacatgaagcttttgaccttcgaagcttccgatttggaaaaggtgaccatgaccctcctcccctttcacgtcaagatactaactttgctctattttgttaatggggttgagttatgaagcaccgatacttttatttcgtatcggtttggatacttcacctatggctatgtgtatatgtccaatgcatgaatttcaagaaacattgtctctttcatgaaccaaagatggaaattattcttatttgtagacaataggataggaagtgatttatgattacaatgatttattgttggaaaaaccacctaaattgtggtcacccctagactgaggggtgtgttgaaagtcccacatggcggatagctgtgggcaaaagggagacatgttgaagtctcccattgtctaaagttagtgccgagatacacggtataaatggggagtaatcctcaccttaaaacttggttttgtagaattgggttagactcataactctctttctgacatttataattttattttgtttttagtaatatataagaagtatgttcttaatttggatttgtagaattgcaattatatatttattatgttttatgattttttatacatatctatatgtgtatcttatacgtattgtatcctatatatttctagaataattgtgtcgtattggatacatgtatcatatatgggcatcataggggttgagttttttttgtaggggggttcgtcaagcaaagttgtggactgcattctctgtttgaaagggtattatgaatggaagctatcgggtggggttggggtgtggaggtatggtggaactgtcaggattacttccttccctaaatggtcttcttccaacatactgggcactgaaagagttgttgatgagaccgagtcatcgcagtttcttcatctgtctggagaggtttcagttgaagaaaccaaagctgctaatgctttggcttctgtttttgatcagtttggactcaaacttctcctggcttacctcagagaggctgatggggttgatgatctgcctttgaatgcaatggtaggtaagatcctttcctatgtggtgtgattttgtaatttttaggactggcaaattagattgttgtttgaaaattgttttgagaaattaaatatatgcatgaagattcatttgattcatgtgatcagcaatcttatttgtgattgggtgaaattgtgtaggtaattgatactttgctcaggaaggttgtcaatgatttttctgcattgcttgattctcaaggcactcaggtacttcagaaattaatgcatcttttttgtcttgctatcacgtttgtaatgtaaaatcactttcagtgtttgtaaggttacctaaaatttaacaattgtccgcagcttggacatttcctcaagaaaatattgaaaggcaatactggttgcctctccaagagagaattcatagaagctatcacattatatctaaatcaaagaggtagtttggcatcaaatgaattctctaaactatgcacttgcggtggaaaacgcgatagtaatcagcacaatgtcagttattctgccaagcatgctgaaataagtgatgcccagcaaaaagagctccaggtataaaattgggaaatacaatgtactgctttagatgatttatcatgcggtattagattagcatcattcactgtaatggtgtttttttccctggtctatagaaactgaagtacttatatgacgagataaaattggaggtcaaacaaattcaatccaagtgggaccaagaattgagaaggcttggtaatgatccaatgacttttttttccatgaaaaatattcttcatgtatgtaaaatcttttataatgcaatattctttcataatgctaagtcgagttctatgtactacttagagaatcatataaagagccttgaagaggcctcctcttcctaccacaaagttttggaggagaatcgctctctttacaatcaagtacaagatctcaaaggtacacaagaatccgagatgctttttcaaggatctacttacatgatttatgtattttaatagatttgcttccttacaggagccattagggtctactgcagagtgaggccattcttaccaggacaatcaaatggacaatctactgtagattatataggagacaatggaaacataatgattatgaatccccataagcaaggaaaagatgctagaagggtattttcattcaataaggtgtttgcaacaagtgccacccaaggtattttaattttttgacatattattgcaaaatgtatagggccagcaaatactttgttctatgtgattattcctaaatgactctctgtaaaatgtagtaaagatttgaaaataataatggacattttttgacatgttgttttagataatagagatttggttatgtaatgaagaatgaacaaaaacgagtatttgtatactggattgttaaatgataataatcatgatatcttatgtaatgtatttgttacaaataaaataatcttttttgaaatttatatcttctctgtcaaaacttatatgatgatttttctttgtcatgtgcagagcaaatatatgctgacactcaaccattggttaggtccgccttagatggctataatgtatgcatctttgcatatggacagactgggtcaggaaagacctacacaatggtaacattacatacataaaaattctagcacatagaagcaatctatcacaattttatgcatttacttaaattgaagtgttgtcctcattctaaattctctgtttttattgcatgcctcataagaaagatcaaaatttatgtgttttgcactgaaattggtgactttcttttcatgtactagtagaaaaatgtagatttttgtccactgtttgtggtgcatgttatggatacttgaaatcaagaatattatgatttgttatggtacgcaattcttttaatagtatcttatcttggtttggagatgtttcttcttaaaaaggagacaattaaaattttaaaaagacctgcatgttattaaatatgttttcatcagcacaaagaaaactgattgtattatttatggacttgatcaaaccttaaccacattgaaagtgtgatatcacaaaatcattttaatattgtcttatcatttttcttatgcatgtgcgttttactgcttggatagagtggccctgatctgatgactgaagagacatggggtgtaaactatagggctttgcgtgacttatttcatatttcaaaggaaagagcagatgccataaaatatgaagttggcgtccagatgattgaaatatacaatgaacaagtgagagatttattagtcagcgatggctctaacagaagatatccttcaagcccatacattctgtatttctattaaattgtaatcatttttcacttctgtatatcaaaactttttgcatactcccccccaaaaaaacaatatcatatatttttttggcttgttcatttccttaacaagacatacattagatatacgaaacaactctcaattgaatggtcttaatgtgcctgatgcatctttagtcccagttaattgtactcaagatgttcttgatttaatgaaaattggtcagaagaatcgtgctgttggtgctacagctctaaatgagcgaagcagccgttctcataggtaaaatttcttcttcataaatattgatggctactttaaccatataatatatttttcttaaataaatttctttaccatccaattgcagtgtgttgacagttcatgtcagagggagggacttagtgtctaactccactcttaagggttgtctccatcttgtggatttggctggaagtgagagagtggacaaatctgaggctgttggcgagagactaaaggaggcccagcatataaataaatctctttctgcacttggggatgttatctctgctttggcacataagagtccacatattccttatagaaatagcaagctcacacaagttctacaagattcattaggtaacaagcagacttaaattgatttttttctctctgtacacattcctcattataattggctagaacaaacttaaaagttgggattgttttctttttcagcttcaaccaccatctttttctactacagatttttgccctctgttgttttaattgttttttagttgggaaggggttgagatgggttgattaatgaattgcaatttaaatattgatattaatgtatttggatcattccatagtaattttatatttttaatttctgtataaaacaacttaacctgtgttttttccctctatatcaataggtggccatgcaaaaactttgatgtttgttcatataaatcctgaagtcaatgctcttggagaaacaattagcacacttaagtttgcagagagggttgcaaccattgaacttggtgctgctcaatctaataaagaaactggagaaattcgggagctaaaggaagaggtttggtttttggtcataactatagcaattttaaagttaactttagccaatattataacagtttgagcattttatagatatcaaatatcaaatcagcattggagaggaaggaaactgaactacaacaatggaaagctgggaatacacgaaataccatagaatctcagaaagcaccaagagctgtttcacctttccgtttgcccaaaaatggtaccagtgacaacatgaaacctgaaaattgtcaaagacccatggatgatagaagctctgaggttattgcatgcttatataaactttaatgataaatttggttaaattatattaggaaattgtatcacaatgaagtgtaatttgtactctctaaatctgaaattatatttacaggctaaaacttgttcttcgggtaagcaaagaaggtcaagatttccctcaacatttatagagaaggactccatgccaaaaatgtctcttctagctgaagaaaaattagtgagctcagggaaaggtagatcaccatcacctccagtcaggaggagatcaatatcgactgatagagggtctgtcattaaaagcaaggtcaaaagtgacacatcagacaaccaaccaatcttaaagcatccatttccaactagagtactagtaaataaatcgcttgtcacaatgccaatggcctcatctacagagaataattcaagggtgaatctgcattcacaggagccagtgaagcaggataacactaatgaaactctcttcaacctccagatggtaaactccaggaaagttcatcaagaacacgaagaggaacaaatcaagcaagctcctggttcagtaagacaaggtggtactaggaacaacaaggctgaaagtaaggccaaggttaagcattttcagcaattgccctttaggattcaaaaggctgatatgatacctggttttgacatggaaattggccgtgaaatgaccatggaggcacttcggaaaaacgattattttgagccagaaaatgatatacgcctcatggagtctgcagtcaatggtgttgtaaatattaaaaagatacatcagaacatctctaggaattctcagaacattggatcaaggtatggcttaaagaatcattaaaaaattatgctatgctcgttgatttgtttcttctcattgaaaatgacattattcaaagcttgattgataaatgagtattattgtcacatgcagaggaataatgcaagcagctgagcctttattgtccagcaaagttgaaaacaaaattttactacatgctacaggtcgcaatcttaaggaaggcaccaatactacattgcctgaatttagaaggagccgatctacgccacgtgggaagttttttgttttctcttgaggatttcaggttaaaatttgataattttttacattatttatttttgtacagtgacaactattgatgtgcatgttggagtgccggctcacataattttgttgactgaggtctcgaggtcagtttgtgcgaccttttcctctgttttcgtgttatgttgctcgtttgtaatttaaatttttggatgtcattatacttctgaaatcttgaggtgttgtgctacattgataagaggtatatttactgcattttatgaattcagcttcccattacaaattcaacaaaagtaatggaagaaggtaaaaataatttattgaaaagcttgttattacaattgtacaaggttgaatatttttttaattataaaatattgtatttttttaatatattttacaaattagtcctgtatttttttttttttttagaaagcttctactgttagcattccatttcatatcaacgttcagactttagcgtatacatgtttcacattcagtcaaattattatactcccgtaactcgcccatggaattattgaattataatctctataggacgctacatgtgtacttaatggttataaaaatgaagaactaacaaccaatagttatgaaaattgacatcgaaatattaggtcagtgagtcagatgtttagttggagggttatttattaatccggtatatatattaatatttttaaaaatatatataatgtatctaatataatgtgattaattcatatttttattctctaaaattaaatttattgtcacgaactaattataaaatattatatagttatttattactataaattattattattttattggatattattattaaattattaagaaaacttttattttttaagactaaatacaaaagttatcaaataatcataaataagtttgttaaatatgtataaaacatataaatattaaattatattatgatcaatatgataataattagttattatatattgttattagataaaaatatatattataggattatattatatgttattcaatgattaactattaacaatttaacatataggaattgagggaaaaaaaaacttgataggatcaaattaggccaacttagtttgggtcaccatatttgaccaaatttgattaggtcaatctgggccaaactaaattgaatatatttccggtcttttattttaattggaatgctcagggcactaatattgattgaactagtcaactaatttagaccgatttttataactatgctaacaacttgacctttttgtataaaattctaaaatgagagactgtataaaaagaattgaaatattttgaggagcctttactctctctctcacacaacctgttcaatgccaaaacacaggaaatggtcaaaggataaccaggaattgaggcaacaagatgacgatttccaatataataattgatgtttattgctttagaaataaatttaagttcaatctcatcagaatattaaattagtttttataacttttggcatataaatatataatatattataaatatagggttttctctcatggatataccaatttttcagttagtatagcaaggtgcataaaaaatttagggcagaaaagccaactttatcttttattctaattctaataaactcattatagggataatatagtaatttgacataatatattaggtgcttctctctcctaaacaaattctctcaccatgttttcggatctgcactgcaccctcctcgacatatcatcctcaatcgcggcttccgttttgctaatttgcacaacacggttttgctaatatcctctgcataaatatggaactatctcagttgttattctaaattttcggtgcaccttactaatgcacaccaactgaaaatgtggtgtgtgcatattagcaaaccccatatattaaatttaagtccaacctcgtcataatattcaatttaatgtatttacaaaataataataacaatggaaggattttctaaaagcatgctatattagtacctgataacatctcgaccagcacattcctttgatgccttttttccaaatatgacgcttactaaaattaattaggttgaaaataatgcagaaaacggctctagtagggttaaagttataagtgcaacttatttccattttcatctttcaatttgagagagacattaatctattaatagataaaagcaataaaaaggatcatatgttctcgtgacatctcattgacaaccacaacctagattttgttcctcaaagcgtgtcttaattttcacataaattctcaacattgagattcattagtcattcaacctttgattaagaacccctttgaagctgttcgtgttttgaatcaacaaggcgtgaaattaagatgatggttcattgttctattgttagaagcatctttgatgggtttaccaattataattctctttgaccattggaggccaaagaggatcaattttcgatcctacaagaagataagaaaatcatatacatttgcaggctcaatccagacttgtccaagttatagaatctgtgatgttagccattccaaaaccacattccaggaagaaaacaacatgcaaggataataaagccacgaaaatagatgcccctcagagttttgtcacctttgtttatcaaaccaaagtagcagaattgttacgaagtataacagtttcatggtgcaaggaccccacgaatcatttcctttccatgagcatcgacaacactttggaagagaacaagtacacctgcaagattgatttggaatccgggcaatcttggggtaaaaagggtcttagatcatttgaaatagcaggtgcaagagtagacattttttgggattttcggcatgcagaattctccgccacaagtccacagccttgctcgggttattacgttgccttggtttacaagaaagaggtgcttctgttgttgggagatttggagaaggatgcttatgaaagaaccaaatcaaaaccatccctagatgaggctaccttgttgtgcaagagagacaatgtgtatgggaagaaaatgttttgtaccagagccattctggaagatggtaagacagaacatgatgttgtgattgagacttccctttctgggcctgatgatccagaaatgtggattaacatagatgggatgttggccagtagaataatgaacttgcattggagattcagagggaatgaaatagtgatggtgaataatttgcctgtgcaaatcttttgggatgttcatgattggcttttcaccaatgaccttggtttaggccctgctttctttgttttcaagccagtctttttggaaactactagcgattctaatagcatagaatgcctagaaagaggtgggggtagcaacggaagtgaattactagaggagaattcatccacccaaggtttttgccattatctttatgcttggagaattgcttgagattcattgtgtgttctccaaaaagtcttgatcttttttggtagtaaagcaaaaaggtgttgcttttcatacattttctttaatagcattgacatcgagttattgaaaacagtgtctcttgcccctttcttatttttccttccttgagctatttgatatatatgaccaggaaaaatagtaactaaacaactagcttaaatttttaaggtatgacctataataagttaaattataaaatggatcttctgaattagggtgtacttggaaatctatttacacctttctaaacttaagttttcccacatctcggtacacaaatgtagaaggaaagggaaggatggattgactgttaaattcaactaaatatattttcaaacacgtacgtagtttagatttataaactcaaaattcactatttttaccaaattataacacaaccaaccacttaacaacatttaaaaatgtcaataccatctaattgtgtcttaagatgattttgtaaaattctttaaaaaaatacaaagaatgaaacatctctctctacacacatacataaatggtttatatatatatatatataatgtgtccatgggcacatgataaagaaccttaaatgccaatgtttataattattttaaaaagttttagcacaataactcctgtcagcttgtttcgaatgtataattatttctttgtatagctacttctttttggatgtcaaaccaaattactacttaataagaattaacattccttgaaaaagaggtgatccagttgtaccaactatattttgttacaattgtactttagataacaacttgtgttttaatacaataaacttttccttttaataaaaaatatatttaatttattttttatcatgtgtccacgtaaaaacactcattaatttttctttttctttaatttaatatggtcctacaaaaagttagaaccaataatatcatgcatactatccaattccttatcactcgttaaaaattgattctaaaatatgagtggagattggttcaagtgtgaagttgtgaatatgtgattatgccagctattgtatcctgcattttcaattacatttcgaaaagtttatttgggaataaaaatttgcaggtgcaggaaacaaatgttatgccttgctgactgtcagagagtgacaggccaagcccagacagcccgttttaactgggtcatggggaaatcagcccgattcaaattagcccagcccacgagggctaatccgggccgacccaaatgtcaggccccataccggaaaacaaaatttggacaaaataaaaaagaggagaggagaaacgaaccaaaaatggggaaccccttcgtttggaaggcacaaattatggttgcatgaacatggcaggtttcgcggcaaacatcggcttcaaaatcccgtcccactttccctgtcgcgttttttcaattcatcggtaacttctctctctcatttttagctctaaaccttctttggttactgaaacaaaatggcagaaaagcttgattcttgtgagagtaaatgagtaatggagttctagtttagctacccaattggaagcattctactgggttgaaggaagttcttcaatttctttctgtctctccacccacttacatataaatataagcttcagctttctatagattctgaaacattttgaccattgttctaattatttattttttaatttggtattaaaaaataggagtatttggaagtttcagattagcttgaagagaagagactatagttcttctgttcctgttaggtgcatttccagcacatcctgcagggtgaaaatacttgaaactgcactgccagtgaaaagcctgggatattgtagctgtcctgatgttaatgtgctcaagataaatggtggaaaagatgtgcatgcaacaattgcacattgtgaaatttctcaagacccgaatgaaatttgccctgacttattatttgatgacagtgaacaaggtaaacttctattttctatttaatatgatatggttttggttcatcatttggtagttagttgtgcttcgctatgcaggatgcaggggaactacgtcactactacctatagctaaatacaatagatttatttgtgattttaagcattctaattcaatttgatgcctgacatgggattgttgactcggatttaagtctggtgattcaatgttcttatattgtggtactggataaactcagcttgccataaaagtaataagagattgttcacacttttgaggatacattgtgatttgtgattgatggtctttgtaattgataaattgaataaaaataagcttcttacaaaaaaaaatgacgcttgttaagaaaataatgggaaagaaaggagaagcttatggttaactaaagttaattttctccaggttctaataggatcgatctccttctactattaagattggggatggataataggttcatgcttctagattcagtgatatacattgtgtgtttgttttcaccgattaaaaaatttacattcattatcttcttttaacctgtttttaactctttaaaacttgtggcttctttctatctttgttgtaatgggatattctgctgcggaaccaaacattatgattagaaatgaaacagcacttacaacttgtatatctaagaagtgaagttgttctgagcgttgtaatttgtgattgtaggttctttggatcaaatggaagaggttggagagttgacaatccatgagggaggagactcttgtgaccaggaattgatacaaattgacaaatttacaagggatgtcgaggaagctgctattaaattacttgcatctaggttaattgttgtctccccttccctcctcccagaaatagaatttattcagtgctagactagttataaactgtattgtcaatccaattgaagagtttctgaaccaaatatgggcgagcataatgcttgttcattttttaagtgcaacaaaaatcaatttttgccatgctattatgagtttgcagttaattgttgctgttttccctgttgaggaaacttcctttttaagttttactcagtgtgtcaagtatttaccttctttcaacacttccattaagaaattgaagaaaatgtcaagtacttcatctaagttgagtttggggagggtacatgcatgcatccttatctccttaagggaaggctgtttccaagatttgaacttgtgacctttaagtcacaaggcaaaaaccttactatagtgccaactgccaaggctcaacatgaaagctaaaagacaaatttaaaacatagtatgtgttactttggcattgtagtcactatctacttacaaatatcccatgtattttttttagaaatttcaacttgattgaagttgtttgtatatttttatattgaagaatgaggttatgccgaacgaagtgttatcttatttggcatgcctttagaaacatcttagcaaattgtcattaacaatgaatttctttgagttgagtttgcttataagttgttaactaagagaagaaattttgtaataattagtaaactaatatcttttcccttttggaaagaggagtgtgcatgtttaaatgtaaaaatgcagtcttttcttttaagcatgcttgtctctctgttccacagggcactcacagcacttgagttgagaaagaaattgcttggaaagagattctctgctgatgcagtggaggcagtgataaacaagttccagagaaggtatgtagttaactagataaaaactgtggagagctgttgtttattagccaattttaattgcttccttacttgaagctttacttgcttccagacaactacttcctaaatttggtttcctttaagttttttatccagttacaacaaattgagagcaatatatgttatgttatgtgatttctggccttaaaaatgagatgtctgcaattataaattgctatcacaaaggtgactttgaatgcagctctagccaactattaattcagtcatggggtctccatgagaaaaatggctagataactggatattgaggaagaatgaatgtcttgagaatttgagtggcccatctaatataatttgacatatggtcatttaccaatttaagtcttatgtagtatatatgcatagagttgtttagttttttatacagcacgtagatcaacacttattttttcattttaatttattttgtgtgtcagaaactgatgaactatttttccacctttttttcattgaagagcaaatggatataacatatttggattacagaaaacagggaaaaggaatcaagaaatttaaagtgtgtttggtatggcttgttttgcagaaatatcaaataatcattttttgggcttcctgaaagtgcttttgaaaccgaaaaagtttcacctattctatgtgtttggactaacttattttgtattcaaaacaacttataataaaaaggaaattatgtaagtttgctgatattgtagaatgaaaaggaaatgatctctgcttttaccttgacattataattttaccaggtcacttgtggtgaagggtgattacttgtcaacaatcaactcactgaaaattgttttttagtatcttagaataaagaagagtgaagatgaacattaagtgcggttgtaatgaagatatttattaacacaaatcatggagtttgttttgggaatcgaattttgttttttctttttccattttaggatgtagttgtttgactgtgagtaaagcttcaaataaaggatgcatttgaaaatggctgataaacaacagatctactgtttttatatgaagttaacatgttttctttttccatttaacttttcttgctttaggaaggatagagactctgaattttttaaaaagagagtatatcctatgattaattctatattaattcaaacactattattttatatatgcagataaagtaattctgttctattcagaataaactgtgtggtacatgcatctcaatttttttttaaaagtttgcatatacccatttatatcatgttaatttgatattgtgcagtctttttcaaaatatgcttttttaagttcatttataaactgagtttgcagacatttttatactttatgtttacttatggtgattggtttaaccttttttgtatcagagggttcatcaatgataggttgtacgctgaaacattttctcaatctagatggacttcatcaagttgggggccaaggcggatcaaacaagttaatcttctttgcattttttgtttgtcctattactttttgctttcttacatgttggctgttccattctgcttttttatcttcttgatcaatacttcttccccgtgttttgttattaatcccattgcagtgcagaagaggaaataattgtgttagcattatgcttatattgtgcttgctaaaattcatcatcattttaactctagaatatagaattaggaggaaaagatgacgtgcattgtgacagcatcttgctaattcagcagagcagtatgcattcactttttttccctttccacaattactcttttgggaacacaaatgtgaaaatctgaaaatatatacttgcatacgaggacaatgttaaaataataatatatcatttactaagtaattatctgtatctgaaaatttagcttgtgcatgtaatctatattttgatttttccctacatctaaaagcttttgaagtttaattatgtcttttgcctgcttgacttgtgtcataatttggcttatttttcatagcgaattgttcaacaaatgcaaagcttcgacccaattcttttctcttgtaatttatctgatcgaataatttcttctattacttggctacttgttgagggctctatttatttcattttaaaactatctgattatttttttcccaaatatgcaaaaattgcctagattgaattgaacctaatcccttcccctcctccagaaaaggtaaaaccgattgattgaaggcttgaatcttctctactcatcattttcctcgagtttagatgccccaaacacactatggatgcacaaaagcagtgtttgcttaaaggttctttactgttgttgtgggccatgcaaggccaaggcacagacctttcaccccacatgccttcagtgcccaatagccatatatacctgctatttcatccaagggagatacttttgtgtgatggattgcaatttttgtggcaggcactgttcaataagggagttagtcaagctgatgctgagaaggcagttgaagtggtctttaaggacaatgattgtgccgaagatcacaagtcagttattggcttgtcaaaatattccatggatcatctttatactcaggcctcaaagcagtggttcagaggtcagaatgtactcaaggagacaaggaaatcacgaattgttcggtggcttcagtaccgtggctttgactggaatgtcattaacttcatactaaagaaattagacaggcaggaccagaattctccatagtgcacaattgggacatccaacattcatatccatctggaaattcattggtgggctccatacatgtttcttgaaaatgtatagtgtgtaatatggtagggttgaagcctcctttggctcttaatgctgttgcaagaaaactaatagttcattgcttcaatttgctcaaggccatgtggcatttgaacacacaagactacacttgtctgggtacattgatgctacctttttttcttgttgaggctgagacagcagcaagcaccactaaggaggtgctacttgttgtgagtccactgtgtcaattcttgtagatatcgtgtgatatgatatgatctagaaacaattgatgcgtctgcttatcttaaatgtgtgcttacgctagaaaaattatcaacatgcctatccaataacagtcattcatcaactagcattcagaattctagagcagaatgagtgccattaatgatatgatataatggcatgtgttgaattatttgattatttcataaagcgtaggagacttaaagggctagttggatgcagacgtgcagttaccagaactcttcaatagcaccacagaattttatgtaattttttcgttttaaatatatcattttattttcacattgtttgtttggtttagctttttttgaaagagtgcttattaaaaataagcaattattccctctaaaaaataggtctctcaagtgtgcactaagtttttccttaaataaaatttgtgaaaaatgcgattattcttttttaaaatctggaacacatttatgaggaattgcatagaaaactatcgactttaagttttgcttataaaaaaatatttttaatacattatttattattaggttaaatttaatgtggactttactaattaatagtaaattcaagttatttattgagactcttataataagaaaaacagtattaaaaagagatattaattaatatttttgtagaaaattttcaactaaatatgttaattaaatgaatttaactagaacgtatgacaatgtaaatattttttatactgttaattaattatataattaaaaattagtaattttgttataattaccttattagtcacacataaaatattatctaatttattaataacataattttgttaacaataataatgtattaaaaataaaatataaccatattagtgttgcttgaaaaatattcatcttttttttaaaaagaaaacatattttacagaaaagtaaagaaaaaaagaataaactaaagggtagaatttagtttcctctagtcaaattagtacaaatacatggatgattacaaattagtacaaaataaatggatggattaaaaaaaatgttatatccttttacaatatttttatcaaaatttctaaaacttataaaaaatagttttaaatgaaaaagtaaatgcatttaatactttgaaaatataaaaaaaatatctaataaatgaaaatattattataaaaggatttaaatttgttcataatacaattttcagtgtttacagtcaaaaggaaaagcaggaaaatcatattctgatgagaagaaatgttactttatgacaaatccatgctctaattttcttttctgttcctcctattgttgaagacattcattagtataaaataattgaaatcttcttgcaacttcattttaatttactttattttttgtggatattttaatgtacttaaatcgttattctcgtactcattcttttcacatataatgcaatgccacaaactctgctcctcaattatttccagtcctcttcgtactcttccaagaaatgccagaaagttgttcacgaaagaatcttataagatataactgaataagctttttggtcagttcagagaattttgtgaaccttgcaaatgataaaaaaaattcccttgttcgtatttgcaatctgcatatgctgctggactaactggtctatctgttttacatgttacctttcacatttccagaataataatggtcctgcatgtacatgtgcgtgtgattaagatacacagactttcattcattccaaacttaatatgtgcttctgaaggagtttccaattgttgcaaatgcaaagtctctttcagagagcacatgggacatgtgaggtattgaacgtgggaccatgtggaattgaaaggctgacttgagtatgcgtgcgtgcgtgtgaataagtgaaagagaaagagagagagagagagagagagagagagagagagatgcagcctaagaatcttattttctgtgtaatatccaaaaaaattccaatcattgtaattaatatcacttgttgacagattatttggataaacttaccttagaaaaaaataagaaggtgaaatgaattaaacttgtccaataagttaaaatcaacttatgtgctccagtttttagaaaagttagatgagagaagttcaattttttttttcctcttttaagtacttatgtagaagtttattaaaaatggacttttaagtctactgtgtttattagaaatgccccagttggcagtaatatctgagaagtttcagcacttgtagaccaggaaattattatcattttccatgttagttaattcaccacaaagactaaaatcagaacatcaaaatttgaattcaggtaaaagcacaaaggttacaaagatatcaataatgccaaggtgacttttacatcggattgaggaaccacctagcctgaaacttaattaatttgttgggtgaaaggctctagtctctagattctagaatttttttttattattattatttaaattgaatacatggattcttgaaatatgcattacatatcttggattaaatttgaacatctctagtaattcttctggccagctctaactgacattccatttgtatgcacatgttatgaatcatacgttctctatgagttgcatgcttgctcaacagattgagtcctctgagaaattaaaggaacaattagaagttccatgtgaaacacctttcataggaggtgctggagaagtatgcactgttaaaactccctttaatacatcaggacctgtggttgaggcctcaaaaggtcgaatttccttgagcattgcaacagtgtccttcattgttggacggtcctcggctcggttgctgacacatagaaatgacacggctagagtttgtagcatttcatgcacagtagaaacagttctccctctcagctttgggtcaagaatgtcataagggtctcctttgctagctaagtggttcctaacccactgaaccaagtgcgcacccccaagaagtgttgggtctagggggtgtcttcctgtcaggacctcaagtaggaccacaccaaaactgtacacatcactcttctcagtgatccgttgcatagatgcaatttctgtacatataccaaaacaacaaaaaattagtactatttcaaggggttatgcaagtaccgaaaaataactaattcaaacatagcgtgaaaaaagtacctggagccatgtatccataggagccagcaaggtagggtctttgaactggcttggaattagtataatcaccattttcacttgcaattcttgctaggccaaagtcagcaaggtaaggctgatagccaggacctaacaaaacattcatggctttgacatctccatgcaatatggaaggcacacaatcatggtgcaaatatgcaagtgcatgagccactcccaacataacatcatatctggtctcccattctggttttccctttcctgaaccatgaattaatgagctcaggcttccattagggagatactcataaaacagaagcttcatgttcttgctggacccccaacccagaagcttgatgatgttcttgtgcctaattgaacctagtgcttgaatttcagaagtaaatgctcctgactctgctgatgaccacatctttttaactgctagtatttggccatttggaactgtgaccttgtagacaactccagcgcttccggtgccaatcacattggatgatgtcaagttccggacaatgtcatcaatagagaactcaaacttctgatacaaagttatcagccaattgttgtttccattgagtgctttgttagcaacatgagcacggatcaagacatggatcgtgagaagtactagtactgcactggtgcataagagagtggacattataatctccatagccaatctggcatgacccttggcctcctttctgtcagctggagttgcaacaccaccaacaatgtagagaccatcatttcctgtgagatcgttgagagggagtttccggaagaatggtgtgttaggcaattctccagagaaatcattgaaggaaacattcagtgaaacaaggttgtgaaggtcaaagagagcatccaagttccctgagagcttgttgtgggagaggtcaagcactccaagttttctaagacttgagaactgagttgggatttcaccagaaaactggttacaactaaggttgagaaagatttctagtgaaggaatttgagcaacttccttgggaatttctccagagaaactattgcttcccaagtccagaagttgtaacttggagcaatataggatctctgctgggatgcttccactgagttgattctttcccaagttgagtttggttaattcagttaatgaaccaatggaatgactcagttcacctgttagcctgttgtctgagaggtcagttaactgcaggtttttgggcagattgtctggaattgagccactgagactatttgaatggaggtccagaaactcaaggttttgacatctggataatgttgaaggaatctcccctacaagatgattgctgctcacatccaaaaagttcaatttcttcaagttggtgatctcagatggaatggtacctgccaatctattgtgatttagcctcagcctgtagaggcttgtgcagttacctatctcaggtggtataaagcctgacaaatcattggaaagaagcagcagtttagtgaggttccttagcccaaaaagttgtttgggtattggaccagttaaattgttgtaagagaggtcaagtgcctgaagatcttggcactgggaaagactatctgggatttttcctgtgagcttgttctgccatgcaaagaagagagtcaagcttctcaagttgccaataagaggaggaacctccccagaaatagcattgttgtcaacttccagttgattcagggaagtgcaatttgtgatttcaggaggtataatgcctgaaagcttattaacactcagttgaagcccttgcagatttgatagcttaccaaaactggttggtatgctacctgtgagaagattttctgacaaatctatgacttcaagccgtgtgcagcttccaagctcttttgggattgtacctactatattgttttgccacaagagaagattctgaagcttgctgagctctccaatttgacttgggattgaaccagagattgagttctgatacaagtacaagttctgcaactcactgcacttccctatctcttctgggatagggcctgacagcagagttgtgtaaatggctatggtctgaatttttttcagcatccctattgaagaaggaagactcccagaaatgctggtttctgcaagtcctaacaccaacaagttggtgcagtttccaatgtcccatggcacctcacccttaaggtttgtgttccctcctactctcaacacttggagctcagttaaggagccaatactctttggaatttcaccactcagtttgttgtcatagagtgtcaagttcacaagacttgataaatttcctatgttggatgggatgttgccttcaagaaagttggcatgcagagctaaagtctgcagtttgctcagcctgcaaatttcctctgggatttcacctaagagagaattgccactgagatcaatgacaatgagctccttatagtctccaatttcctttggaaccatgcctgtgatgttggttgttgagaggacaagagtcttcaaggacctgagaggttgaaaatttgaaggtagtgaaccttgcaagttcactgacttcaggtttatctcaaccacctctccttgtaagttgcagtgcaccccaaaccaattgcatggacttgggttggaaggattccaagatgctagtgcatctgaagtactgtttaaactgttcttccatgctaatagagcttggccttgctcattaagggagtaacagcatggaaacaaaagagagtttaataagagaagcaaggtgagggagaagattttgggaggaagtgacagatttcttaagatgacaggcattgctgtgaaagaagagaagtggtgatctgttttgggattgtagagggggaaattctatgaattttttttatagaggaagagaagaagctctggtcagaagagctagcttccttgttcttttattgtgtaataagctcctgttcaatgacaaggacatctccatacccatgatgatgtttgttggtttttattaagctaaacttctctttttatttatttatttcaagatgaacctagggtatctctagacgagagtcaaagactaatctctcaatatattgaaatctatctaagagtctgaccttttccaatatatgttatttcttacacaaactctggggatccaacttatgaccatatatttaaggagcatagttatccgtcaatcatactacactatcttggtaaactcctcttttttattggtttgttgtggttaacgtgtcaagtagtgagttgaaatttttagaaatttgcgatctaaatgtaattcaatttgttagttcctgttagatagtgtttcattaatagtgaactgtgagacatgaaactggttgagggtgaaaataatgtaaagaagattttgcatttttgttccccacgtggacacatattttatattgtttcctgctttaatttggtaataataattacttttcatcttcatgtatttaatcagctgttgagattaattagcagcaagcaacggaaaatgactttagcacttttttgaaattggttattaatgtaattatcttaccttgctctagatagtgatggatgattaatcaaacagaatagacagtttgatggttgagtgtaatagctctctgttcggttaatcaaggagataatttcttcctttaattagctaggcccattttgtggtccatcgcttttgtgtggctgtagtttttgatgagccactgatgtggtggttgctgcatgctaccctttgaatttctgaactttaagcaactaacttgcatatttggatcaaattaccaagagtgcaacgaaaggatttggttccattgtcaaaatctaaattgggtatccatgattggtgtcaagtttactcaaattactgagatattcgtggtgattaattttataggagcaaaatggacataatttagttcacaaatagtaataagacacatttcggtttgtttatatatacttaaatgaaggagtgcgtgaggaatctgatggagaagtgaagtgcacatggaagcaagggaatacatgaagaacgatattataatatgtgcatgatctgttcataagtatttgttggtctttgctttaaagaaataaaaagaaaaccatgaaaggtatgttgaccaagagtggaaggtacaaatttacagtagattgaactattgaattggaattattcgcaaatcaaagctagataactagcaaaaaaaatgtccatttaaatacataaatctaccttcttaatttgcaccaaagtggtcatcacgtgtcacggtttaaaactagaaaatactgagattaaaaaaaaaaaacgttcttgtttttatgtgttgacagaattacaggtacagaagctacctgttccataattgccatgtacttgaagatgccttctggaagtaaaaggtattttcaacaccattttgtgcttttggggtgaagcatgtgcatgtgtagtgtagataactaccaacaatttataacatatttttaatataaaaaagagaactatacattcaataccaataaacagatagttagttaatttgtacagtaccgtgacaagtttagctatagaggtagtttagattgatttgattcaatgaaaggagaaaaaaaaaaagtttagattgatgggacatggcaaaataaacaggattatgattaccttatagaaatgaaagtaattaaggcttgtacgtttaatgcgacaaaggaaaagaaaaacaaaaagaaattctattgtagtgtcttcgggagtagaactcaaatgatgcaactcttctttaaacaaacaaaaattggaagccaagataatcaacgatccctaatccagtatatatcttattcaccatagttagagaacaaaacttaaaagaaagaatttaattaaagtgtatatatatatatatattaactttgtaaagatatttattctggcatttaatcatgaataatcatatatcttattaaattttataatgatagtttaaataaacatagttaaaattatttttaattgacaagagtttaattttcataaattgtcagtgtaattcttttactatcgagatcagtcaattagaatttattatcaatataaattttaaaataattattataaattaataatatttacatacatgacaatttataattaaattataatataaaaatatatactaccaatatatttaaattaaattcgaatccttatggttaggcacatgcatattcaaatttgaacatttcaaatatcttgagagaacataaaattattttggatcccttactctcaatttaaacatcatgttatcctaaaataagtttgtctataaaatctataaaaaaataatatgctgtaaatgaataatatatatatatatatatatatatatatatatatataatatgctgtttctactctctagacacatttacagctatatcaaccttttccagacacacaactttagggtaccgctttccccacctatcatataaatgaatcttgaagatgactgaagatccttatgccttatctaatttgaacttttatgactctgttctgtgcattatgaatctagcaattgcatgatactatcaaaattaatctttgccaattgtcccatctaccatctccttcattttgctgataatagatcgatggggaagtttcagctacacccactaatacatcatgaatcatcaaatcgaaactgtagacttaggacaagttttatttatgatatgcattcgtgtaatgtgtaattgacagctttggattcattgaattcaatagctttaatttaacggtttagaaccaaatagctgcttagatataggcttatagtccacattaatttgaccctaaacttaatcttttactaatttagagatggttgtgcataaaataatggaatttcaaagtaagcatattaatttattatgatgtatgatgacagaagatttatagaaaagaaaataaaagaaaaagtaatatttcatggtaaaggggagatcaacgaggcaaaagagggtgaataaagggaccccaatgacattaaaaagaagagacaaaaggcaccatgtatacatggatggaaattaattcttgcattagtatgaaacgatccatcctctaaccccaccattttattaattgtcggctttaaatctctttgtaaaaaagtagtcataaaggtatatatccaaccccaaaagaaaaagagagcaagtcataaaaggcttcccctgggggcatcttatgaacaatcaagtttacattacacatatggcatgatgtcatttttcacccaatagcaatgaaaaacaagaaggcccttttggatcacttggtaatcccatgcaagatgaattcagtaaatgaaaaagaaagattagacaataagaaaaaaaatgtgatgatgatttccacttccaccataaatttcttcatctctaacagagaaaatcataaataaccacagataaataattagctcctcttgaaaaatgtaattacgcaacacttctagctagcactcccatttacaccaagttatataattgttgattcctctatgtgattctgtcttaattaattaacatatcttataacccatttttaatttttctttcatgcttgcttgttaaattcaagaatttttttttttttaaaataaatactaattttcttttcgtttttcactgccccccatccacacacgcacacaccttcccttcttccttctgagtatttgaattccattatctatgtgactcataccacgacggttttcgacaaacatgaacgaaaattattgtttgtgtatatgaagaatcgtattttttaatctaaatcacattcctgctgttgtatatcgtactacatggatccaccaacatttgattaaaaaaaaacatgaggaacaagtcataagctaatcctcacaaagaaaatagccaggcacatgacatgaaacaaaacattgctggattttctatatatggcaataattaaaaatctaacctatacatgctgctgaggctgtcataatgtggtgcaccttatgtttagattgaagcattgcttatcaacttattatgatattcctgtccattaagattataatacccccccccccccaaaaaaaaaagctccctggttctccaatatttgtttattaaaagtgagtgtcaggcctcggctagctttttgttactttgggaaaacaaattaattgcataaggaaaagagagttgtaattatttgtaagataggtagcttctctttagtgataggttgttagctaggtaggagctcatgcatgctcatgagaggagaatatcgatcaataatctatttgaacaacatcagtggaaaattcaaatttgaccaacaatagagtggccacaaattataaatgtagtacgagtgtctaaacattattattagagcagcgcattagtattgcctatgaacacattatcaccactccattcgattacaatatgagccttctgtccatgcatgttcttattgtattgtcggaagccattttatcactgatatagccgcaacttctactactagtgctggaagatgggccattgatgtgtatgaaagaagctggccattatagagcatggtaattccacccatattattaaattaaagcttaatatgatatcacttacaagattgatagataataatttgaatcaatttatatgaaattattttaatttaataagggatatcaagtttaaatattaagtatctaattatattaaatatggtgaaggagaattttgttatttatattagtcttatttaatttgaagattgttttattacataaaaaagacatgtaatctctaagccgatttttatcaaattaatgattagtgatctgcacattaaattaagctctctctctttttttgtttatttatttatttttgttgttttgcctacctagtcaacattagctctttagcaatcatacaagcaagtgtaatcatacaataaaaacagaatggcttccccgtgccccaaattctggaaatatgagaagaatagagagagaaagatagcgagagattttatgatttgcattgaggtggaccctttgagaggtctaccagtatagcatcataggaacttttgtccttaatgcatggcacacgtgcaatagagtcagcaagtggtgaattcgatgcacatcaagtggacttttgaatccccaataataacacggattgatcgaaccaagcatgatttgttagtgacataataatgaaatcccatcaccataatattaattaattaataagccatatatagggtccatgggcatcaaaaatcatgtaagaagaattgccaagttacacttcccgaattcacacgtttgggaggctccatccctgatcaatatcacaaatcctttactgtttagaaaacaattgaaatctttgtttctttctaattatttggccaattcctccaatttgtgattgtttcccgaaatcatagagataagaccatataggtcgacatcctaagcaatttgtctataattgagatttatcacctaccgcattagcaaattaattcaatgtgaagggagcttagagaccattgccacccaatgagtgaatgcttaaagtcatatatggatccattaattttaattgtttttctctagatcttcactatactaatttttaaacctttcaaagtgctccactgagttttggcttgtttttcctccatgaagattccattattaaaaagactttgccatatccccgaacatagccttatagcttgcccatatatacatataatctttcttgcttgctttctttctttttttgatatattatacagaatatagtatttctaactccaataaaaaaataaatgatattaacctgctaatggattatatagtttggtgatacatatttacttgagttgtgctatttcgtgccaatagtttggtatgaaagaacgaatttgttactaatcaccaaataagaaaatatacacaaaatgacgaataaatgcacaggaaagtaaataattaacatcacgtcattttatattatctgtgcgaatagatagatttcttctcggttaaaagaaaaatatggtcttcaatttcagtctcattccaaagagtcagtttcactctacatattgttagcttgaaaaaacttcgtctttgataaaagatagtggtcctaaagaaaatcacattaaatcaagtgactgtttgatcatatcataattcatagctgtctaaatatatccgtaagttctggtttctgttcctaaatcactttccaaatgctataaattattatatgtaatgtgtgcatggaaagttagaatataataatatcatcctttacatatatgaacccagtactttgaacgtgtcctatcaactccacccacgagtcatgaatggtaagcccaggaattttgctgttagtactttgcaattaaataaactggctagctttgggtcttctggaggttagtggctttttttttttcttaaccattttttaaaaaataattatatttatattactgtgtttgaatttatttattttgaaaaataatattttttattttaaaaaaactattatttttctaaaaaaatcctcctgctgcatgtcagtcgtcaagattagtatgagcaagacatgcagggacatttatttgtcataactttgtttgaccgttaaaaatacaaaaaaaaaaaagtaaaataaaaagagataaataaaataatagtttgtttggataaatagaaatgataaacgataaattaaaaaaattattttaacttatttagatcagaacatttttatccagcataaaaaaaaaagatcataaattttttatccttaggtaaaaaaaaaaaaaatggaaaaaatagagcatgttaaatgagaaatgacctaactattattttgtggatcttacgtaaagaaatctctccttatggtgtggagagaaattttctataaacctcacattggaaaaaaaaaaaaaaaaaaaaaaaaactcctttcttacaaataattacaactcatgcacgtaaagtatgcacggaaaaaactcctttcttacaaattttctataccaattgagtaaaattacatattttatattaaaaaatatcttcttcttcttttcaaattctagttatgttgtacaataaatatattacgtaaagtataagtaaatatctataaaattatacgcccatgccagttaatgcgtaaatatcttatctattacgtactataatatttttgtgtggaaactcattgattttaagatcatctctcttcgttagagttcacaattaaactgcactcatcatccaatggtaaattagcttgcaatttgcaaaacaagttttcatattttattttagtagaaaaagaaacattttcaagggttgcaatgcatctttacagtgaaaaatttagcttgatcggatcatcttgttcacattaattatcttatatactttaatcatggcctatggtcgataaactagttctattcactgtttccattcatcattacaaagcgacctccttgccatcaagataactacaagtcatttttaagataacagtagttagaatcaatattgtggcgtccactgaaacataattaagagcgttgtctcgctaacttgttcaaagattcgtatgcgattcaaaaaataaaacaaagtcatgcagtattaattaattataaaccacgaaccagaataatttaacctataggtaatgtgttatcaaacaaaagtgggaccattacgtgcctaaagttttggtggtcttgaacctatagatttcaatccctataaaactaaaaataactatagagtttttggaaccattatatgtgcccataattttgattatatatattacattttagtggaagatatatacaatgtaatgatctccactatacaataatttcccctttgaaacaagtatttcactttaattaagaagataaaaaaaattaaggacttacataattacatccattaattgttcatattggttaaggtccacataaccttatatatatataatctgtcatatatatgtttttaaccaaaatctcaaccgtttagttatttatttatttatcaatcctcatagatcttcccttttatctctgacatacatgaatccttcacttaaatctaataaataaataaaaagaagccaaagctattttacattccattttggagatgggagggagccagggaacaaccggaagaaagcaacagatttccgtagcccatcaattagataatgttgactagaaaagaagaaagtgttaacttgcgattagaaagtacgatgcatgaatactactatttgtcatggtactcctaaatacttgtacctgtactaggcactattccgtaccacgataccagcatttatttataatgtatatataattagttacatataacattatgaaaaattgtatatatattgtgattgcgattttatactccatcattatatgttcttattttttttacatgaaatatatcttctcatgcacgtatcttaatatgtcttgtcaattttgtggaaccattaattgtacccgaagctgtaccaatggacttgtgttgtgttcctatatccatgcaacacgaatgaatttgttgtgcagatcgatctaggcggcaacaaacagtgaaatcataggaagagttggatgatcagcaatgttcatgttcatgggtcacttccaagtttcagctgacaattcacttgtttggacggaagaacatctttatgcatgggatttttgaatttaaaaatcttcccaaaaactattcccattttaaaaatatatatttttatgtctctatccccaattaattaataaaatatatttaagtggagtttattgtgagatccttaaaagtgactcaagaatccaaaatgtgatttatcttaaagtaaaaaagaaaaaattacttgcatcttgtatgacaccataaaactcacaaaaaattgtccaagaacctaaaattgaatctaccacgcactataagggtagattagaaatctcattccagcagatctgctagttcaaaagcctattgtaggtttcaagaataaactggtattattttagtttctgaacaaatgtatcgtaatactgttatataattactccttgaattctcacgcatcctcttcgcgctagttgggttaggactgaggagagtgaaaaatttttttttttttgttgacatatttgggcttaggtgcttttcggcccaaatcaaagtgaaaggggaaacacacttatttgggcttcaacgactcatccttcactctcccaatctaagtattaaccaaaatacttaattaaatctaacactagcatttaattgtctatacaataaaataaatcctaaataattatttaaacgcattttaatacttaaaattccattttttttaccatacacacaaattcttaatttacttaaatttataataattttctaaactaattgataggattctttttaattattttaagtcaaaaatataaatacataacaattatcaaagcatcaatagtaaaaaataaaataacaatttatttaatatttaaaaatacacgaaattagggaaaagaggatgccatacacatcacatatgataagagacaatatatatatatatatatatatatattactattcattatttttaagtttgataagaaaaagggtaaacttttagttcaaagtaaattgcatgtatttttcatttattccatgccaagtttaacctaagctttgataatatgaaaagatatcattcaatcatatagttaaaagacaaaaaaagagaagtgtaaatattaatgatctccacaaacacacacgtaacaatttattataatgttatatggagcacttgttaacactttgtcaagtgtaccaatttgtccaaataataattagacggtaagtccgaatgtcgatttcacatgacctttgtttgtactcagagttaatacacgttcgtttctaaacaattaattaatcaatttggttctttagagtaaatgacatataattaaacttgacctactaaactatgaagcagtgtaaatacaaataacaaagacacaaacactcagagtattgcagtgatggttgaaatacgatgcgatgtatgttgggagcttaactaatcgaaactaactttgatgcaatattaaagatttttcgctattcaatattattttccaatcaccttcatctactaatatattctagccatgattcctcaagtgcaagaccctaaatcacttaattttgctcttaatcccttaagagttgcattaaccaacttgcattaagattaaagataaacaacttaggctaaacaaaaccattctatccctagaaatggtacatttagaagtgtttttcaattataagaaaataacaattttccaatgtattaaaacctattacaatacatgaaaatgcatgatcaaaccactaacatgataataactcagaaaacaataataatgcgaaaatgacattgaatagataattagaatcattatatttggttgttgagctcccaacaatgggattctagcctcttattttcatatgagacttatacaaatggagggttaaggcaagggaaatggagtggatggagggaaatgaggaacataatgatgaatgacagctccaatggtgtggaatgatgtctccttcgtgacctaagtgcttgttttctgtctgtccaagtgttccaagataatcccctctttttccctcatatttttccttaaaacgcaacttagtgtcgtggtcacgcgcctagcgggacatatcgtgttaagcgtgcctttagtgtccagctggataaatgaccacgcgctaagcgaactagttgcgctgagtggatctctgcgcattgagcgagtagaccctcaattctccttccttgtccttgcagtgaatttttacaaaaaaatacaatcaacaccttatagtcaacaaaatttagcatctactggataaaagctcataaaatgactaattcctaagttttaatcgcaaaaagaagcattaaaaagagaaaaaaaaagagataattgttatgtaatttacatgtaactttgctatgcatagcaattatcaacactccatattagttgggaaagaatgagaaaaaagtgtaaaatataataggtggtgtgcatacttcttacttttatatttccttcactatctttagggtaatcacaatcaaattgattttgcaaaattattttttttaagtaaagtgatttatttatgattatagttttatttaaaatttaaagtaatagtaaaaattggtataattttttttcatctaatgtaaacctacctaaacatgctttaactcaaaatccattatgtgctcataaataatttttcaacatgataccaaacattggaacatttattttaaatcactaaaatccaacactttataaatgtgtgtttgattttatgttgaattgtctaaaatcatgttaaaatatcaactaatgttattttagataatcgttcacatattgaagaattgattatgtacacaaattgagttttaatttttatagacaacttttttattggataagaaaattttatttatttttaattataatttaaatcaattttataaatttaatttcactgataatcaattaaatgatcataaagcacaaaattaaattaaatcaatttaaaatgaaaagtacaataaggtccaacattattgattctttaaatatattggaagagatttaatattaatttttagtctccttaattttgtacttacattaatcaaaatttaaaaaaacacaaacttacaagaaaaaaaaacttacataaacctaaattgaaaaagtacaaactcacataagtttaaaaaaataaaaaaattatataaatcaaaattaaaaaatcataaaaaaaaaacttagagaaaccaaaaatatatcgtgatcctaactcttattttatatcttacctaatttaaaccatctttatatcatatattgctcacactatcttatttctcctatttatagagatacgttattgtaaggacaacaaactattattttttattttttattgtgatccttggtaagaattgcatgaattaggattactaaatctgtaattattagatttagatatatttaatattcatctgtaaacaaatttattaaatttcatcaagatcatttgatatatatttatttctattatatatgatatgaataatttgtaatctatcaaatctaatctaatggctgaaaacgaactaaaccaagtccacggcaaaacggtgatgcaagacgattagttggagcgtagaaggatctagaagacataaaaccctagccaacacttgctatataacttgccactttcttccattttctctaagcactccttccttttcgttctgttctagcatcttcgctgcaactctctaccttccctctttttccgaatttgaaacgaaatggcctcggagactgagacgttcgcttttcaggccgagatcaaccagctcctcagtctaatcatcaacaccttctacagcaacaaggagatctttcttcgtgagctcatcagcaatgcctctgacgtaagatttttatcgatccttgttaggtttttctatttccgtttgttgattacgtcctttactgcgctcgttctttattttcatgtttattgctcaaacacatgcagggtttgttggacatgtctttttccccccttttatttttttgtgatttctcttgcgtgcgtttacctgttgttgtcttcatagttcaacaattgatgtgttttttttttttttttttaatttgttagggttcatgttatgatattgtgctctttccattgttaaacggtgctgattattctctttattatcttaaatagcataattgaaatttattgagtttcgggtacataatttttgtccctgttcctgttgtctctgttatgtgagatttacgtagtactatgccgtttttttttactgcaaccattggatcttgattgaggcaaaactgatgctgttaatacgttcttctatttggggagtgagtggatcgtttggatttggtgtgaattatgctttatttaggttttctcttattctacactttgggccttatatctgattgctgacatgttattacctttacaacaatgtaggccttggacaagattcgatttgagagtcttactgacaagagcaagcttgatgctcagccagagttgttcattcacattattcctgacaagaccaacaacacattgtctatcattgacagtggtattggcatgactaaggctggtaagattaaatattttgttagtctttgtgagattatcgcggactgtgcatgttagttagtctgttttctctaatgcatgtgcgttttatgttccagatttggtgaacaaccttggtactattgcaaggtccgggaccaaggaattcatggaagccctggctgctggtgctgatgtgagcatgattgggcagttcggtgttggtttctactcggcttatcttgtagctgataaggttattgttaccacaaagcacaatgatgatgaacagtatgtctgggagtcacatgccggtggctcatttactgtgacaagagatacatctggtgagaaccttggtaggggaacaaagatgactttgtttcttaaggaagatcaacttgagtatcttgaggaacgccgtctgaaggatttgataaagaagcattctgaattcattagctatcctatttctctctggattgagaagactactgaaaaggagatttctgatgatgaggatgaggaagagaagaaggatgaggagggtaaagttgaagatgtggatgaagataaggagaaggaggagaagaaaaagaagaccattaaggaggtatctcacgagtggtcattggtgaacaagcagaagcctatttggatgaggaaacctgaagagattacaaaagaagaatatgctgctttctacaagagtcttaccaatgattgggaagagcatttggctgttaagcacttttctgttgagggtcagctggagtttaaggctgtcctctttattcccaagagagcaccttttgatctctttgacactaagaagaagcctaacaacatcaaattgtatgtccgccgtgtcttcatcatggacaactgtgaggagttgatgcctgaatatcttagctttgttaagggtattgtggattctgaggatcttcctctcaacatttctagagaaatgctgcagcaaaacaagatcctgaaagtcatcaggaagaacttggtcaagaagtgcgttgagatgttctttgaaattgctgagaacaaggaggactataacaagttttatgaagccttctctaagaacctaaaacttggtattcatgaggattctcagaacaagacaaagctagctgaattgctcaggtatcactccactaagagtggtgatgagatgaccagcctcaaggactatgttaccaggatgaaggaaggacagaatgacatctactacattactggggaaagcaagaaagctgttgagaattcccccttccttgaaaagcttaagaagaaggggtacgaggttctctacatggttgatgctattgatgagtatgctgttggtcagcttaaggaatttgagggaaagaagttggtctctgctaccaaggaaggactgaaacttgacgagagtgaagacgagaagaaaaagaaggaagaactaaaggataaatttgagggtctttgccatgtgatcaaggatgtgttgggtgacaaggtggagaaagttgtggtgtctgatcgtgttgtggattctccttgctgtctggtgacaggtgaatatgggtggacagccaacatggaaaggattatgaaagcacaggcattgagggacagcagcatggctggatacatgtcgagcaagaagacgatggagattaaccctgagaaccccatcatggaggagctgaggaagcgagcagatgctgataagaatgacaaatctgtgaaggatctcgtgctcttgctctttgagactgctcttctaacttctgggttcagccttgatgatcccaacactttcggtaacaggattcacaggatgctgaagcttggactgagtattgatgaagatgctggtgaagcagatgctgacatgatgcctcctctggaggacgctgatgccgatgctgagggtagcaagatggaagaagttgattaaatctgacttaattgcctgttttgtttttagaaagaaacaatgattggagaaacagtcttttaatatgttttatgttttttgaattttcgaaattttggaatgttggctagtttggtgccgttttctggattagtagtgtatgtagtttctttatggtaaatttgtgtccgctctctggccaatgaatttgtgctttcttcggataaacgtgtatgctgattgcggaagtttcagttcgggaatgaaaatgtttttacttctgagtgaaattaatcgctttgacgtggggataagaggattggtcaaatgacacaattatgagtttaaaaatgtcattcctaattaactgtttatgatttttttgaacgtttaaatatttgtttttgtttttgtttttgtaattttttttaatccttatttacaatttttttccttaaacatattagataacattttttttctgtttaaaatattttttattatttatagagttatctaaaatattttaaaataaataaatatattttataaagactaatgaaaaaaaattatagaaataaaaattaaaagtgttaaattacagaaaaaaaaatttaaacctaaattgaaaacaatgttgttgaaaatttttgcatttttaattactttaccttttaattattttctaaacttactatttgttctctcaaactcatttaaaagataaaagaaattatagacagataagtgcacctttatgttaaatatgtaaggacctttatatccattgccactttcttttttatattaaaatttaaacaatgtctgaatatttacatttttgaaaaatagcattactccttgttataattcattctcagaacatttttgcgttttttaggaataattttattttataaatatttattttgctttgaaaagtaataatccgttaatttggcaaaaaacaggtagtaatccgtatgcacctataatcttatatatagggactttcaagaatgaagattggctgcttaacttctagcataccctcacggaaggtaaaagaatgcgctgatgtcttctatgtatatattctatctatataataaaatataataaaagaaggaaggggcctgatcagtttgaaaattgctaattacacctcttttttgataagtttctcaggaaaaaattgaaacttgctaaatgataagtctcgcaatcctaactgataagtctcgcaaccctaactgataagtctcgcaaccctaactaataaaagaaggaaggggcctgacacccccatcagtttgaaaattgctaattacacctcttttttgataagtttctcaggaaaaaattgaaacttgctaaatgataagtctcgcaatcctaactgataagtctcgcaaccctaactaataagtctctcagcaaaaaaaaattgaaacttgctaattgcacctcctttttgataaatccctctattaaattttgatacttgctaattgcacctcctttttgataagtatactccaatatttccttttaaattttaaatgcctattatgtcttttctttcatctctctcacacattctctctttaaagtgtaggcagtgatattacctatgtacgcagggtatcgtactaactagttgcaaaactacaaaatttcaatattattttcatctttccttatggagagactctaaaccactggtgatatagtaattgtttgttggtgcatattgcagggtatcgtactagccagttgcaaatttacaagattccaatattattttcatcattccttttagagagactcaaaatcaccgatgatatagtaattatttgttggtgcatcttgcattccttcactactacatcgataccgttggtaagtatgttttctcatccttttggtcattttcacctttcttattgttacatgtatttcatatttgtttttaattttcctcatttttgtttaatggatttcttgatatttttcatttgagaaatcaaaaggattttgtccaacaagaagtcgtgggtatgtgttgattctcatccatcttttttttatcattttcacttttgtgattctaatgtcaaatttacaggcatttgatgcatctttcatctctctcacaccttttttatgttacatatatttcatatttgtttttaatttccctcatttttgcttaatggatttcttgatgtttttcatttgagaaatcaaaagggttttgttcaacaacaaaaagtcgtggatatgtgttgattctcatccatcttttttttcttttcattttcacttttgtgattctaatgtcaaagtttcttggtgtttttaattttaacattagtaagtagtcatggcctcgtgggtaagtgcagttgttgtctttcattttatattatgatttctacaatctcctcctttgagtccttcatcttttgttatatatatatatatatatatatatatatatttttttttttttattgaaggttttttttattattttatttcagaagttagaagctctatgaactaattaaacacctattgttacttactatcattctttctcaatgttgttggttcttacctcaattagttgagtctaattattgatagatttacaaaggtgtgacaagagatgaagccttaagtggatcaatggcttaaggtctgatttcaagagaggtatattatcacaagaaaaaaaatcattatttaacttcatttcttttttttttcctcttatttttgctacacatccattttgtcattaataaactatgctagatcttgcattttttaaatatgtttccagtctagatggtatattgttttaactacatttttaagagttatgtgtgttcaaatatcttctttgagaaatatgacttcagctctatgcataatcaaaaaatggtaaaaaaaatattgataataatgtatgttatattattcctttttgtattttttctattctatattttattttattctttaacatatttaatattaaataatttatgttcactaaaataataacatttagttaatatatattataaaataataatttgattctttgttatataacggtcaaagttaattaatttaaattattttattaaaaatatcataaattaaaatacttttagttaatattaaatatcttttaggcatccattttcttattttttttaaaatagacaacatttattagtttttgtttttatttattaagttctaaaaagttacaaatgaatatatatacaattatattatatatttaacggatacaattaagtatatataattatattatacattagattttatgacttaagagtatgtccacacgaatactttactagttagctaaacgtggagcgtcttcgtctcaacatgttccagttttggagcagtctttctgatgttcaaatgcttctcttggcagatgctttactgtatgtttatattctgctagtttggttgcctattttattatgcggaatgattaaaaaaaaagatgacataatatttttattattattatttataaaaatccataaaatttaacagttaacatattatataaaataaattaatataattaataattgattattgaactctttttaagaagtttttcttaggccccaataattttagacaaggccatgccatgatctccgtatccaactttccaataggaaaaaataaataaaagtggttaatatattaaaaataatgtcaaattatttgtacagtatcagagtttaatccttgattaaaatacttattttttattgaatttcagattagtcaaaatctcttttagactaattgaacgttaaagacaaaaaaataataataaagtttggcagagtaaaagagataaatcaagtaaaaacttatcccacaaaaaaattaattataataatatttttgttattaaaaaacttattttactacacgtaagttagttaacatgagagttctttccattgaaactttgcaatattcacaacatattcaagcacagaagccaggcaaggctagtattgagatttgagtgagtggttagagctcattgcagagagattggagccaacagagctggcatggctcattcctgaacggtggtgccggcacctgaaggatccaacatgtgtggtgggtgagcatagacaattcctcctttcactcgaagacttcttcaatgcagatgcagcttgaggtgttggtgacacagacacaaccatatttgactgcttattgatataatccatattcaaaccaggtatttttatttctttaccattcagcttcattagattcatgcaaggggactttttctccatatttccctccatccctttcctgaccacgcatattcaattaagaattaaccatctaacatttgagcaaatcaacaactaaacaatttaacaagataactgcatgtggttggactttacattttttttttttttgggtgaatgactggggcaatcagctccaagaaactagcttaaaaaccacaagggaacacagtcgagcttacatctgccataacagcaggtaaaacagaatcataaacatgccaatcatcatctaaagacattggtaaaacagataattgcacggttggactttacataacagctgcatgtgttagattcttaaaaaatgtgttaactgctaataatgtcctatgccttgtgtctaaggacatatatgcatatgatggagatcaaagaagagagttagttaccttgtgatgcgcttatcttaatttccttgttgtgttatgattttctttggatgtgtgctatataatactactatatgatttgcttatgaagcaagatatcacgaattaaagacatggtacatgcataatgctaatgacataacaacaacattaaatcatgtttcatgacaagatgcttgattggtttccctcttatgaatcatgtatgtatactttgtaaatgttgattgtagggtgaagccatatataatataagtgattaatttatacctagatagttgagaaggcgtgtacaaaatatgatgtccttccgcagatgaattgcttggttcacttgaggctttggattctctgcaacaatgtagagagggagggcccctagtatgatattatgcttcctctgaagattcagaaaacctcagctcttagatagcacaaatcttgggcgttaaccatctcagtttcgttgtttcaaatatgtggtatttattcaatcaacaatttatggcgacaagttctcaaaaagctctgctggcgttttttcttctcaacctagttggacatgagatactatgactatgataggtcttttccttgatatgattgacaaattggcaataatttaacagcttccgtgacgctgtacttcttttggatattctttatttttcaccattttgattctttattgtcacgttgacaatcttaagctaattttacagcgataatgccttcttgttgcttgttgcttcatattattgtgctttttttgggttggtttgacaacttttaggctattttaggacaagaataacaatacttggataaatttatttagtagttggttttatttagttgtgaattttaatattagatatgcaaaataaatcatatctgttcattcgatatcaacacagcctacatcaatggcaatcaaaatattctggtagaaggccgaaaagtagcatgtgtacaaagactatactaaagagtggacatttttttttttttttggcaatttgtttagggggaaaaaccctaaataatggacattttattgtttaagaattaaggaacgaatatattacttgctttaattttttccctacagagatgcagatgcttatctaacagtatttagatgacaatacaagaaaaatcactaatttgaatggttatgggatccattccttacaaccaagtacacattatagttttggtcactggtgagctactctgtacatatacaaactcactcaagtgacacgtgtaaagtatattaaaccaaaatttaaggaaaagaagaagaaaaaactgagggtaatatcaagagtatacatgtgaccaaataagatcaatccttttgactgttgtttctgctatttctacctctctaatccttgtttgcaaagagggcaacatgatgtaatttttagccattgatccacacattttaggtggaacatatgggaacagggcaattgtctaacttcctctttgtctttgtacttggctaagcagatacagcattcctgtaagcacatcagaacataacaaatctatcaattcaatagaaattgaaatatgacaaatcttaaaatgaatggaacttaaaagcatacatccaaatcgagggtaaaaatgcccaactacattactagctgttaagtggctagctagctgtacatcaagtcaagggctagtaaacaacacacttgtcatttttgtctcatttagcttttagggttgcattacttgagctctattttgatacatttctccatgaaacacatgaagtgcataagttcattttaatttataggagacgtttaatttattttatctttctattttcttctagtaaaagtgcttgtagaaaaaactatccaaataaggcctagtctatatctactaatggtaccacttactgggtcttcattgatcaattgtttactgccttcagagccattgcgaagctctaactctacaccggcttctttatgtctccaacttggaagttgtgaaatttgatcatcagaagctcctttattggaagaggccatgttcatgttgtagccgaggagggtgctaattagtggcacacagcagcataacaacacaaacagtaggaaagggaaagagtagcacattgcattccaagcaaggagaatgatgcagagcacatggagctttggagcatgatgaaaagatccaaaacgtgagtcaaaaacccaaacatttcccatcacaaaccatatggcgaagaaaagctcaagtgaagtccggcatttattcatcaagtgtgacatcctgtacaatacagtgcaaattaaaattacaacttcaaatttcaaccaaaaaaaagttgcatggctctaaaaataaaaacaaaaacttgtttctctgattgagtcaatgacttctccaacatttattttcagtagggaaactctcaaaagcacttctgacttgtatccaaacaggtcttatatgaaagttatttcagacaatataatacaaatagagtttacaatttattttttaattcctaattggtactgttaattcttggaaatggttttcgtcaacttgaaattacaatacattttaatagaaaaagaagttggtaaaacttctatattagtcttttcaattttcacatgatttatatcctcaacgagataaaaaaaaatgcaataaacaaaagattctactctttcaaaagtaaatgccacgaactgatcgcagtgaaaaaggtatgtgagggtatttgattcctccaagctctttttaaggggataaattaaaattatgataactttatgattacttgacacttggtattttcctatcttctaacaatccaacttgttttgtccaaatattatttataatcaattcaaggagaacaatttatttttatataacagttatatttaaccaacaaaacgatggtatcaagcttttctagcaaattttagagcatactcatgcattagtacactataatatagccaataagtacaattaattacccattcctaataataaaattgtctgaaataaaattgttgaaggttgaagtgcacaggatacctggtttcttcattgtttctctgctgttccatatcagaaaggctgagagaatctccttgagttagataaatttgacggtagcgtccataaagtagaagcagattaagaacacagccaatatcataaccagaaatccaaatcctcataggccaaataggtctctccctcttggaaatagccaaagtgaacgttgtaatcgttatttggagaatcaaggcaataaactccagcatcatccaagtgctagaattgaaagggttggagccaaggttggaccttgatccattttggtaatgaaaaactcttctcaaaaaggcaaaccatctggctctagatattctcatggccatccgaaccataaaggaaggaggggtgacacgtggaggcctgtttcgagcactagccactctatcttctgaggcagaatttgaagaaaatggaaccatgctatactcttgttgtggatgaacaaggaagcacctagaattcattggaaatgttttcttttgcctgtgtgtgttgagaatttgtccaagacgtgtatcagagatcaagtaattgaatccagcagcagtattaatttcttaaaagcacaggttttcatcaaaagaaccttgaaattgaagcatcccaattggcaactttgttgatggatggaactagtaccttgattggaagatcttttctgggtctgcaccacctttaactcctagcaacataatcagacaaatatcacaaaaagcttcaataacatgatcctttcagcaaccacaaactgtagagaaaggttaagaataggaaaaatatgaagaggggatggagctgatgaagtgtatatagaagaggaggaagggaagattggtgtgaaggatatgtcaggaaggtgaggttgtgtctcagagggtgacaaagaatcgaactgctaagttttgctttgattcgaagggaatcacaaggtttggagggaacttaaccgttggccaacttcctctaggctttatttttatatgaagccaagctcagaaagcaattggacttcaatttcccttcttttctctccctttctttgtcggctaaaatattttgatccgtaatcttattttttgtttttgttttgttcccataagtttaatgtccattttttcgtcttcttgccaatattttgttaattgactgaaattttaacttgaatctaaaaaaataaaacgagggacccaaaagttattttaacattgtttgtttgtctctttatatattaaaagattatcacaaacgcagatttttattttatttttttggtgaaaataaagtgaagtctatctctctttgaaataaagtgggctaagacttaaaagttattatctgatactatacgctgggcatttgtttacattatggccaacaaaatttcaaccttttaattctttatatgataaatgaatcataaaacatgatttgaattctggcgggtacagttgatattttgggattatgtggtaaacggttggccacctaatccaaccaacagttaatttgtgtcacattggagtagtgtggccctccttgtgtctaggaataattgctatgttttacgtattaaccacacaactcctaagtttcttctttttattacatgttgtaaattgttctaattgaagaaaaatctttgaagttcggttaattaagagtaagattaaatcttttgtaattgtatagactcatacaggagcgaaactaggttcttcgctatagggacagtcaccctccgagtaaataaaatttactgtcacccatccccatgaattctaatattgacccccctccctctcgatgaattttactatttcttcttttttacgttgatgatcagtttatagttttatatttctaccagagttcttggtaatatctgtatcttattttccaaagattccagtattatctagtcaacacgcgtataaattaaaataataaaatttgatttcaaatattaactaattaattatttcatatgctataaataattttagctattatagattaattgcttttaattacattgattttttggtacaggttcaactatgttaattattttcgaatatgctttatcatttatttagtaggttttaaattaatttttttattacattttaaattactcttaatttgatagataaaataatttaattttgagaaaaattatttttttttctatgaatcattgtcaatttatgtgttaaatttttgcctctctatcacttttttcctgattccgccactgacctcataggtggcctaacctaagtttaaacagcgccaccgatattttttttcagatgaaaataaggaaccgctagatggtttctaaagatgattgaatgtagagttgtatgagtacaatattattttgctacagtgaataagtttatttttactaatattataggtctgtcaaaaatgtgtttggctaacagaacatcagttgcgatgatttctatagtcgttagtttgactcataaattatagtcgtattaggccataactaatattctagaatcaaaattaacttgtgggatcacgcaagccgaatgggtcaccatccgctgattaatgtaggagaaagtagggctagcagaagtaaaaacaaacaaaatttgatcatattgctaagcaattattggaaactagatatagacctatgcattgaacatcttaaattaattttttctattgatttttctatttcttcgtatgtggtcattttggtgcatacatgcacttgatgtagagctagtgttagtctccatttgttttagtcattcaaaaagcataaactaattaaagagattaaaattacttaaaaaaaaaagagatttttttggttacatgtttttttttgttacaaaaaaaaaacactgcaacgtagaattgatcattgatcagaccactaaaatattaacattgcaacgcacaccttggcccctaaaaggaaaattaaagtatatgggtggaaaattaaaaggaaaaaagaaatgaaaacgtagaattgtcgacccaaactatcgattatacctaattttctatttggttaccataaatccaaatcaaacgtgggaaagcctaaattagaggccaaaaatttgacggctaaaggtcaaattcatgcgttgttaatttacgaatggagcaaagtgtaaaaatttcaaatatacattttatatgatccttagttctaaatagatcagagaaaaatcattttgggatcaatattaatttttaatttttaaaaaagaaaaaaggtcgcgtcaagtttaaaatcaacataaaataagtggccttaaccctcacgactaaatgctgaagagctactacataaaaggaaatcagagagggaatctataaggaatgagcgagatgtttaatcagcgtgataattaaggttacttgaatgaataaaattaaaccatgcgttaaccattaagaatttggcaagtgttgctgaagtggctatattccaaagaaaacatataattaacaaataaaagacgtcgattaagtttgttttgacgtattaggatcaaatttgaccccaatttgggcggtgagacatgcaacgtgttagtgttgacgtatcttgcaaaggaaagcaatcactttcggaaaatggataagaaatgggaactgttgaatttgaacacgaaacttatcttcatgtatacacggagaaatcaaaaggcttcaaagttgaagcaaaaaggttgattacgttaatttgaaaagtatgcaaaatcatcctcaaaatttcatgtgcttgccccggttgtcctcgtaccaactataaattcacaaaacttctaaaccaaatttaccatatgctgtgcatcaatcacaaattatattagaatttacttttacaataattattgtaaaaattacaaaactccaacatcttgattaaaaactatttgactttgaccaacttcgaacagtagtacatttggatggttctccaataaaaggtgcatgtcacattctgtatagtaactaaacaattgcttgagttggataggttagatttgtacgcgcatacaaatattcaatataattgagtaaaagtcagtcacatacatgcagcttccgatttcaaggcataattatacagcacgaatttgttttctcttgtcaattaagtgtatcatcgttaaacagtaaggacaaaaaaaagttgttgctagcgggggtcttaattaccgacttcgtctatcataatattgtgcacaatagattatatttgaactgctttttcagactgatattcaagttaatgatcaacgaattacaacaactggtctgcaacaaaattgactacaataattatatggatttatctattttcaatttttatataatagaaatataatttattctccccttttccatatatttttaataagattttttgaaagttctatcatattgtgtcccttaggtaggatcatgaggtgatctttaagaaccaattaagctcttggagataacaaaagaaatcagaaataacttcaaccgaaagtttctgcataatacatcaaataatactgtaataggacttaaggttttgttctaaaaggaacttggtgggtctacgcaggccatgggatgtacatacatatacatgcgtgatattaagttcttgacacacatgttgcttgttacaaaattccatttaaaaattccgtgagtgttatttagactcctcactcccatcccatgtgtttcttgtgctctgctctttcgattcaggataatgcttaattatttacacctcacgtggcacttacaaaatatatcatatttatagcatgtataaattataacatatatcctacttatatattaaaattttatattatattgttttaaatgaaaacatgtttaaatatcctatttacgtaatccctaattttttagaattgtagcgtatatttttaacccgcacaacacatggataaatatcaattttaaattcaatttagccattatgcaaaaacaaaatcaatttaatccttatttgtaattatgtcctcactgattgctacatttatatcatcatttattggaattacaacaaagtcaaatgtagtaactaatttagttacaacaaacctaatcatttaaatttgtaattttttttactaaaatgtatcaaaattaaactatctttatgtaaaaacaaacattttttcctgcatgcaaaaaaaacttaaaaataattattctggacattttaaacatgtgaattgtgaatatctgatccaacgtaaactttgtgtacttatgtgcatattttcttaggtccattgaaaaagtatgaacagttattgaaaaagtatgaacagttagactttatgtctgacagtaatagtagctcttaataattagacaaaaatagtttttgtccaaagtatactttgatttttcttaatttcagttctaggaaaacaaactcctatgttatcaatcacaataatcaaatgatatagatgaaaagaataagtacaaacaaatgacggcctagacaggctccactgctagaatggcaaagaacaatgtactagcactctaccagacatcttcaaccgcaaaaatatacagtcatagacacaaatagaaacctaatttgccttctcctttaccttgtcatcaggtttgcccaaaacaaattcagcatataaatccttcagagcaatcatgactgtagttatcaatggccccaaaatagctccctgtggaacaacagaatccttcagcaaatgttatgaaatacgaggaaaatgcatccatacaagttcactaataagccgacccacacttgagctactacacctatacattggatcccacatgctcacacacaaaagttacacaagcagataaccatttcaaacgaagttgtgcaggcaaaccagtctaaattctagaacaaatataggttagaaatttcatgttaatctaaaaaattacaatgtaagactattagtagttcaaattgagtaagaaaagagtaaatagtctatgtacactggtagtataaagggtttttacattgtcatatatgataaataagtttattaattttttttacaataaagtcatacctctatgagagtgcataaaaattaaacactaaagaaaaatatcagaatatcaaaacatggaggggtaacaatttacctctagagctgatggaaacaaagccattcccccaatgatgctcagtccagtaagatatgcactgtgtccaggcacatcttcaagaatctcagttgccccataatccatgaggaaaaggtgagcaacagacaagaaaatggccactatgtatctgccttctagtaccagctgtagtgttgctggaattgttgcaagccaagatggaaatattggtagcaaagggctaaggaaggcaatgacagttgacacatataagaaatgtattctgtatagcctaaacaaaagccaagtcaggcatccttggaagaatgcaatctcagcagtggccaaaaggactcctgaaatagccttatccaacacttcaacacacctgaccctggccgagtttgacatcggaaccatgttcatcacttgttctgttgccccacctgactctgatgtgatgagataatacaaaacccagaaaaacaccattgcctgagacacaaaattgaaaacctccgcagcaccagagactatggaattcaaaatggagatcacaaactttgcaccacttccaagcacacttgtaccactagccaaaacacgctgaccaacatccatccctttaaccgcatacccttttgccttctcaaccaaatcccccctagtaattataaggtcttggaaaagggtatcaagttctgcataaatctccccccactccttattcctaaccctacccttcaaactcaagagcttttctgtgtatggtgaaggcaccattaacgaatccgttgaagaagagttagcactagcactagcaggagcagttatcacaaactgcttaataaccgtcacaaattcagtcagattgtactgcattgccaacccatcaatctgatcagaaaccgtctcatagaactgactagtgtacttatccaccatcccagcaacatcattctcctccatccacttcttcacaccgattctctcagcgtaattgttctcttccactcgaaccttcagcgaaatcactgcctctttcccttcgccgccaatcttgtaagagaagaatataaccccactcaagaacccaacaatcatgccaacaatcaacccaacagccacaacggttttcaacctcttcaatacccctcttgtgaaaaatgcaccagagggaaagaaaagtgagaaactgaaatccacgttcttggaactgaaaacaaagcctaatcctagaagtgacagagacccaacagcaccaagcctctcataagcagcaacaaacaccccaaaggacaagagcaaacgaagcacggtggaaaagccgctacgcttctttgtgttgtcattctcattctcaggctttggcttcctgagaagggttctgagagaagcttcacgaatctcaacaagggttgtaatgaagagcgtgaagacggtgaggggaagggcgaggagggtgtgaaggaggcctagattgagagggtgagaccaaaagcaaacggtggtttggtgaatgagtctgagagggatggaacagagaacagcccattgaaagggtttgaggtactgttggaggagtttgtagagagagaagaggatcagaatggccatggcgagcccggcgtgggccatggctatgtagagggccaggcgcgcttgagactgagagtcgccggaggggttgactttttggtcggcatttgacggcggcggcggaggaggaggaggatcggaggtgggttttcggagggatgcggatcggaacatgtcgtgccacggtggggtggtggtggcagagttagggtcagagtaagggacaaggtccatctaagaacagaacagaaatagtagtgaagtgcaaataatgttagtgaatgaatgtgttatgttatgggtgtgctggctaaggatgttgtgtctgtcagtaaggattgaatggctaataaaagaaagagatacagtaatagtagtatcatttgatttccaagttttgtggtaaaaaagtgaacactgcagctttttaaactgacaggaagtaatagtacgaactatgaatatgaagtgaaaagattggaaaaaaaaaaaagagaggaagaactggtacttggcttcgttcgtgtcttatgttccattgcggcattgcattcttcacgtgcccgcaagtcatcccaatcttcatcataactaaattagtatgagatttcgtaagccattaattaattaagtaatcactaacagttttatcttatatctttaaattactctactcacgaacaatactgtaaagtgtatatttttttcttttgtttaagtaaaaaattaacatgtaattcttttcttttaatcgaaaatgataaggaaattattgataattttaaaagagagttttatggaagaattgaattataactcaataaatttaaaatttatttttttaaggatgagatcaataggtacttttattatttatttatttaaataaatattaagatgtatttatttttaaaaaatattagaagagacaaaattcaatgggtctaatccataactaatttataaaattgaatcttatctatcttacaaatatatcaagggataaataattgatccaattattagattttttttaaggctttaaaagagtcgtattattaggtgaaaactttatgtccaattctataacaaagattgtagcaataatgtcatgaatgactaggattatctaatttttttttttttaagtataattgatatagtttatgcgcaatcaaaatataatttttggggtggaatttctgccatcaacctatggatttgatcatttttctaatatcttctatagtaaaatgtgaaaaagtacctaatttaacggaaggggaagaagaattaaaatatttaatgtatcataatgattaaaatgtacgtattttaagtaaaaggttgataaagtatggggcagctacttttttttttttaaaaataaatttatagtttcttatctacatttttttttaatttggttgctaaagtttaaaaatttattttatttcctttaaaatgtttgttagaacaaattgctccttagtttttgtcaccaatatgtcaattttggttgatatgacatacatttatataatatgacatttttcaccgtttgccacgtattactaagttaataaattagtatgagaaactaataaaatggtcaattcagtttaacatagacattttaagaaattaaagtgatagctttctaaatttaagagaccaaactgaaataaaatatgtaaataagagatcaattttttttttaacttttctttatggtatatgggtcaactaatctatgttacaacagaagaaatggaagaaaaaaaaaacattaatttcatttgtagattgaagcatcaagccgtaaaaaacataactctgttatgaagcacatttctttaaaatggttggtacttggtagagcttgaatacagtatttattttttcttgcattgcgttttttcggctactgtttatcctgaaaaggcaactagacagtagacaccagcagagacacactttttttctcaaatgttgctgtttagttaacaacagcatagaagacatgttgttcatttcatgagagactaattgcaaatgtcaattcttctgcggagacagaagtaagctaacacgcggaagcatagagccatggctaccagaacccatgcttcagttaagcctccttccaagtctacagtgtcaaatgatggtgaactctgcagtgtcctgcaccctccttcgctttcacactcatatggttgctctcctgaatactgcacttttagaagtagtctgaacccatagtacacgaacgacaaatacttcaaccaatgcatcatcttcggtacgtgctgcatgcaacacaatcaagcgttctgtgaaggaaggctagcttttgaataaaaaatgagtacaactcttaccaaatgatcatgcatgaatatgtcacttccaaaacaaactaattattggtttatgtgtgttaaggcatggatgtgctgacgtgacaatgcattaacatatgaaccaaaattgtacaactaaaatagtagggattaaattcacgagaaaaaaaaaagatttgagaggcaaaattcgtgaaattgagaaagtagggagacaaagttgcagttaagcatacaaattacaatgttgctactccttgtgcatagcatacatacctggacatagtagccacctgtgagaaggaataacattagtatcaaagaagcaaccatccctgctctttgaatgctcataactgcagctccaaatagttctcctgccccctattaacaacattgtattcattaaagcttcaaacaaaaatgataacacgtcgtttacttattatgagtctcaacatagcttacttgacttgttatagctattaaaagcaccgcgaacaaagtcaggaagaagcaagcaacagtgctcttaaatccggccatgaagtacaagattaacatgaaaaaagtagggtagaaaacatgtgccaccatgtcacacagagtgctgcttgcatagtacacactcagtctatacatgtctgcttttctttctttcaccaagtaggccttttcaaatggaaagacatagactgctccaaaaatacatgaagatgtccagaatatacatatatagaacattaaaccaacctgcaccaaaaatagtagttcattctaatgttaatgttgaagagacaggtagagcagctcagccttgaaaaaattgaaatcaatatcatggaaactacctgatctctaacttgagcctctgtattggtagaagatttccaccaaagtaatcccaacaaaagtgcaatgccaagtgcttgaactagtcttaatttatcaaaatagtccttgcttcttgctttgaatgttctcttataaagaataacgaattggtcgcaccaactcactgtccagtcccttttaacctgaatggctagctgaagatgttctggtgtgtttgctgctccatgattctcttctttttcttttggctccagtgtgtctttgtacttgagttgtagatactaacataaaataaaggatcaattattaaatagaaatgacatagaacaagcatataagacttatataatacataaatctaacgttaataacagcttttgaagagtcagcagattcttgatctttcaaaatatcttgtcgaacgcttatgttattcacttgtccagttgccaagtcaagcaagaactctgcaggattcattggtatttccgggatgaacctcaaggatgaaaagtactgcattgagtccttagccttcccgtagtaaatgggatagccttctgatatcagaagaagtttgtcaaacatgtgaaagattctgctggatggctggtgaattgttgtgattatggtccttccaccctttaggcaaatcaaaagtaaattgtggggttatagaaatgaagcatgttatcaaaatgacagttaaatatagttactgataccttggcaagcccctgaagagttagaaggagtctgtttgctgaggtggaatcaaggcccgaagttggttcatcaagtagcagcagtgaaggatcaacaaggatttcatagcctatgttggttcgcttcctttctcctccagatatgcctttcagatatcctccacctatttttgtgtggcggcatctatgtttatataagagattatttagggaagcagttttatttcattctttgcttgcggcttactcgaaatcataataactaatttttagtcaattgtggaagattcaaagaatcaattaatgtaacacacctttcaaggccaagatccttgacagtgttctccactctagcatatttttgttgcttgctcatattgcttggcagtcttaagaatgcagagaagattaatgtttcctctactgtaagttgtgggaaaagcacatcctcttgtgtcacaaatccaatcctataagtcagaaaaagaagaaaataaaacaaaacaaacagaagagtgcttatgttctgttaaaatataaaagcacatgtcatgacatggatgctgatgtctatgaagctttctaacctcctcttgacagctggattaaatcgaacatcattataagttatcttcccctgcacattgtcaattaatcttccacctataactctcaacaaggttgttttcccactaccagaaggacccatcaaagcaagaatttcaccagggccaatgcttcctgtgatactcttcaaaattttcttgtatctatcttcctccacgtggtgttgtgtgcctacttttgacatcattgtcttcacagggttcttggaagccgcttggctatccctcaccttgaactctacatcttcaaactgcacattaatgagaattttgagagcaaatgacagtaatcataaatacacaattaaaacactgttgatgagaatattcttattgaaatcaattttcaatatcaagtggtaatcatcaagatcctcaatagcattgcatgaagaactatgattctcataaaaagaaaaactttgctctaatgcaatcgaagaaaataacatatggtccatgaccatcacaagtccatggttctggccgatttctatgtaccacacgtaaccgaattttcttaactcttgtaaattgaaaaactcgattacatgccacatgaaaattggccgaaaccatctatatgtggtggtcctgaaccatactataatttctcctaatgcacgtggaaagaaaattctaataaagttgtagaatttagccatttttctctaccttgagataaatggggagggggggatcttggtcgaaactgaaatcctcaacttttatgtcaatctctgtgtacatatttggaaggtatgcctgagacatgaactccatgctgtgaccaaagccattgctccctgcaatctgcatggagccaatagatggaggtgacattgacatgtcctcaatctcatcttctctttccttctccatgatcttggattctatgagaactttgttgaagccaggtagtctaataatgtagtttaattagatatatcgtgagtcaactgcatcagaccaagaccttgcctatatattgaggcagaattttagttggtgggccacgtacttttcatgacaagttcttggtccatgaaaggcatggatgttattctcacatatcctttcaatttaaccattatcatttgtcataagaacatgtcaagaacatgaataaattggcttggtaagtaattgaccattaatggaatacacgctgcatgtctttaatctcgtgtctatcaaattgatgcaattcgtctcattaaaaaaaataaaaatagttcatttacaatgaataataggctaaattatgtgattgataacagtcatgtccgtaacggcaatgccattttgtagattcacttctctttttcaagtgtttggtgctttgaagaccatctaatatttgtcatgtatactttttactcacaaaacactgatgtgtaaatcagtaaatctatttgacgactcttttagtgttgtgggatggtcaaccggagtcacgggtataatttgtagacaccttgttttaagttcaatctattgttttttaattatgctcattaatgtttggttgagtaatatgtgataatattgtctgaattaatcatggtcattgtcttgttattgatgcaaacaatttaatattatatttctaaacattctaagtttgatttcgttaaccattacttcaaggcataatttaattagaaattaaaaatttaacatttaacatttaattagaaattaaaaaaatattaagaatgtaacattaaatgttacaaatagatttttggtgtcgtcattttgtagaaagcctatgatttattgacttttttaacaatcaatagatgataaaactattcttaattttagataatattaactttaatgcactgttgagagaattaacagccatagatgtttattaaaggcatttcagattaatatattatcaatcaattctcagaagattcaaaaagaaatatatatatatatatatatatatatatatatatataagtgaaaaatatgtaagatatgataggaatagaaaaactgaaaaagaatatgtatctaactgatagtacagtgaagcaagtagcattaatcaaactaatttgttagcagtcacagtatagcagagcggttgtgttgggcccaaaatctgtgttttctgtcttgatttggttttttcatttcatgggtcacccttcatgcagtcatgccaccatattcactttgacgttgaagaaatttaaaacgaaaaatttactagtaacccattttatcgtaatttttttaacacatctctaataaaaaaattattattacttctgtaagactgtaactattatccttaagttatatttcctctaatttcgtatataagtaaaaacaactactttcatattgattaaaaaagataattaaaattatttaattttattaatctcaaataaaaaataaaattatttttaaaatattctttattagaacttgatattaaaaataacatttttacttataatcagatttgcttatacttgagtctaaaataccaaataacatttttacttatataagtcgagagaaaatatttgatgatattaaaaatatgatcatatgatcactaatgcacctattagaaacttaagtgtgtttgagaaaaggttagcaatactaattgatccctttacatttttggggagcaatatatatacttgaaggaaacttggggcatgtggactcgctttgtcaataaaaaaaattcagcaaagactcgacacaccatccttaacctttcaaatgaacaacggaatgaaaactacctgactctcacacacaacacgaatccatggacttattaattgaaagtataaattggataccaaaatttgcaccctgtcctgttcccaccctcggaaaatgaatgtataacgtaaagacattaatactttgtttagtttagaaaataaaataaaaaaatgagaatggattttttgttttaaagttagatgatattttaattgtttaataagaaagaaaatgaaaataaagttttatatgtgttaagaaaaaaaagttgtatctaaagtgacataaataacctaaaaagagagagaaccatgacaaataaataaataaaatatcattttagtccttttataatataaagcttactttcgactcttttttttctctaatttgggcaaaacaaatttttggtggtctcaacaaaaaatttcttgtttctttgtctcctctcttttcaattcaaccaaagagagtgtaacttttgaatggaaacaaaaaaattgtaatttaaattaaaggtgttacgaagtagtttgagtccaattcgtaaatatttttttcatgggacagtatgaaattacaaatgttagtaatgggaaagtaatttatactcatgaatagtgaatcatttcttgttatgagtaaaatgaccttgccactgaatcacaataagatataactgtccatgtccatgagagattttggtccctatttcaggaattcaacctacctgatggctatctataccatcaatccaaatgtagcaaataaaatctaaattacactaaacttgttagtatattcttatatcataaatttgaatcctcatacgtgaataaaagtatttttaatatattcttatatcataaatttgtgtgtgtaaaatttacaaaaaataaacattttaaaatatataaattatattgtaattcaaatcatactaaataaatatatttaataaataagttatattttagatttatatgataaacaattatatgatgatacaagattacttttaacttctgataatttcttttaaaaattgaaatccaatttagaaataaagataataatataaattgaaagagaaaaatgattaagaaaagtcaattatatgtatattgatttaagatggtcaaaagagaatttcttttcacaagatattaagccaaccatctcaaaacactctctttttatatttatccatgttttattaatcatttatctcttttaatttattttctatctttattttaaattaaaatttataactttcaaaagaaattaaattataaataattcaaaataatcttatattacaatataaatgtttatcataaatacaaactataatttatatagtaaacaatatttatttactataaattctaattataatataatttatattttcaaaactaatcattttttaaagatttaattaaataaaaataaacatttatcccatataatatatggactaaaatactagtttaatctacaaaagagaaaagaaaaaaaaagtttgcattactttaacggttaatggtaccaaccagttggtaggatatcttcaaatctgcatttggatcagttagtaagatggaacttttgcatcaagtttagtgatgatatataccttatcagaaaagacgttgtatccatgagattaggcaatcttacctaaactaaaagcgtgcatagcggtcgttgctacaagtgtcttgactatttcctaatgatataacaataattcatgatgttatattaacttcccgtaaatcaacagttacatcaattcctagtataccagatatcatagacaggtgttgcatgctagtagtaccttcttcagctacacttctagtaagcttgaattgagaaacacgtgttgccaaattgttggcactctcatcaaatgctaaattctcttggaacataaagcaaattcccttcacttttctcttttgtctttttattttttttattttcatgcaattgaaaaacccctccttgaagaatgtcaattttctgtttccccataagcacctaacatacattgattgtattttaagcaacatggcctattaattcatatttatatgacccttttttctctttgcctttctgttttggcttccttaatctaattggtatagaatagtgttttagaaagagtgtctagcatcttgaataaatatgtgatccaagtccatgaataggccagattgttatggggtggttggattcactgtggggaagaggacgaaagtttattaaaaggaaagacagtgatgctggcgatgcaggtctttctgaatttcttagctgatttcattgtgactcagttttatttcatgcaactgagtggttttatatctaatttgcataatgtacatccaacttttgtttttacctatgttcatatattgttttttttctttttctgggattggcttgtgaacttttcatgttcaactcttgatgaatagatcccaactatcttaatcttacattaataattattttcccctgctcattctgtgtgaaatactattcatcgtttaagaatcattggatactccggccttggcggttgtaaattataagtttgttacgttactctctctctctctctctctctctttacattcataatctctgttgtttatgttatggttttactgatcctagaaactttctgagacccattttgattttgaattgaactgatacttctctgtttatttttctgcaactttcattgatgttctcagtagccaattaaaaaaaatgacacttgaaatgaatgtatgaatttgatctaatattcatcttgttttcattcttccttctttggcatctgcccttatgctccattcttctttttctgttaagtgttgaactataatgcacttcttttatttccacagctgattagaactcaatttatttgagtcttctttaggcaaaattctcatgagtatttgtaggagaaaaaataaaataaaagaaataaaacaagtttctccattaacttatatgtaaaaagtattagttttttcaaaagttgattttaactttatacacaagctaattttgtgccctggagtaatattggggacatattcaatgtttacaagtttcccttttgcaatgaaatgattataagatattactcattagtcattaccattgattccaatatccttgatcccaataccaatataaactagacttggtgtacgctccagctaatgattgaaactatatcaggtagagcactggaagaactcagagcttctctctacaatgagatccgaacctcagaaggagccaagcgccaacagcaaagatattgtggaccagtggtggcactgtccttcaattttatggttgctgttgggattatcatggcaaacaaattggtcagtacaatttgcttcttttctatcatgtattatataatgtgatgaactgaatgtcccaactagtcattacaagcctattgattgatcaagcacccttacatgtatatgttgttaacaggtgatgggtaaagttggcttcaactttccaattttcctcacatttgtacactacatcactgcatggcttctccttgccattttcaagacactctcagtgcttcctgtgtcccctccatctaaaacaactccattctcttctttatttgcacttggtgttgttatggcctttgcctctggccttgcaaacaccagcctcaagtataacaggtttattcacttgctttagcatctttatgaattatgataaaaagatttggaactttactttttgctgacaatccagctcttgcagtgttggtttctaccaaatggctaagattgctgttaccccaacgattgttcttgcggagttcattctttttggaaaaaccattgattttaaaaaggtgaggaattactcttcttcccttctttttcttttctactcttttataaagcatttcacatatcttaaaaaggactattccaaccccctttctttgtttttagtgcactaatcatgtatgtcattgcaataatgcaggttttggctttggctgtcgtgtcagcaggtgtagctgttgcaactgtaacagatttagggttcaacttatttggtgctctaattgcaattgcatggataatcccaagtgccataaataagattttatggtctactttacaacagcaaggcaactggacagctctggcgtaagtaatattaattagagtacatttggaagagtttatttgcaacttatttggacttatcttgcaacataaatatttgtattagcatttgacttagtttatgaaaataactttcaacttatataaaaactgtttagccttggtttctcttcgattttatacataagcatgatacaacatttattcaagaagtgcttaattaaactatttacttaaaaacttttgtgattgtagattgatgtggaagacaaccccgatcacagttttcttcctcggggcattgatgccgtggatagatccaccaggagtcctatccttcaagtgggatgtgaacaactcaactgcagttttggtatctgctctccttggttttctcttgcagtggtcaggggcattggcattggggtactgagattacattcctcttccaacaccattttttgacatataatgttgttttcttttaatgttagataacatcacactatgaatctatgattgcagggccacttctgctacaacccatgttgtcttaggacagtttaaaacatgtgtgattctgttgggagggtatctattatttgactcagatcctggggttgtgagcattggtggtgctgttgttgctctctctgggatgtcagtttacacatcattgaatttgcaagagcctcaggagccttcatcgaagccgaaatcaacaagtgaagacaccacatctacagattcaaatgtaaatactactaccactaccactaccactacctctagcacccttgtatgtgtcatatagtagatgatgaatcatgaatacaagaacaccccatttttcagacaccacgtccttggttttagcaattagcgaaactttatgtatagacagtactggaaattcgttgagattttttaagggtagcttgcttttcacaaagttccatcaatctctttaatttcttaaatgaaaaaagcattatcaactattcaactgaatgatgttcaagggctttggctttagcacacatcttatataagttcgtcgaccaccactgacacactctgagataatgacttattactcaacagatgacatgtctggttaagttagaaaaaagaaacgagcatggtcttgcaaatggaaagccacaaaaaacagaggagtttccacgataaatttagccgctattgtattcattatttagggaatgtaacaaatcgttaatttcgaaggtttaactcattttcacaaagtgaacaagcagtagaatcattacaccgtctataatgtttttgatggtagagcaactttgtttgaaaatgttacattgtaacctcaaatcttatactaacactttataagaaaggtaaatgtaatgattaaaaatgtaagaaatgtttgtataaatacacaaaagctcaagtgtatagctgtaattttattttgatattaatattaatatcataaaattattatgtggagattttttaatactttttaaaattttgtatattaattttaaaatattaatattttgtttaataatgacatccatatatcaaatgataaattactatagaattttgtaataaaaataaactttgaatgactaaattattaaaataaagtatatacataatataagtaataatgttagtaacttagtattattataattcaaattaatattaacagttcaaatcaatattattttttccttgattaattattcagttaacatatttttattttatttttaattcatttaaataatacttaacaaaattatgtataatattaagcataaacatatttcaaaataacattaaaaattgccattaatagaaaagtgttatctacataacacaagtcaggttggtaattgtattcaaactctttttttcttttgaaacacaaagccgttacatttatgaaataacagtgtcgtaaatacaagtattaaattaaaagtctgagatttagcataaaattacaccaaataagttatgtaataaaacatctgagatttagcataaaattacaccaaataagtatgtaataaaaattctgagagctagcgtaaaattacacaactgcctaataagtgagcaacgtaattaacttgcatccttgcacaccaccctccatggtactcaaactctctttagaaatagtttgacttaattaaacatttcatgtctctagtttctcgatttcgcaaatttcatttccaaattttctacatgaatatgattcttcactgttttaatttaacatctaataaccaaccgaaaatataatgtcgcattatttagatatatcatatttaacatctaacactcgtgaaaaaaaaattggaagatgaagttttctagattaaatatatgaatttttttggagttactaaacatatatgatttggtaagagttcatctattaacatctaaatatttaacaaaaaatactaatgtaacattgtcacatcaacaaatccacatatatcttaatatcacatcaatattatcattaaatactcaagttaattaatagatcaaaattacataattaaaatattaaatcaaatttgcaaaaaaaataaaaatgcaattcataaaattgagaaaataaagaaaccaaaagtacaataaacctaataattttaacttataccaaacacattagactataatttatcattgtccacgctcacgtaatcatgggatcaagtatgcaaattaacatttttttttttgccttttctaaatgagggataatggataacaagttaatacaggcaccaaattgcacaatttaaaaataagactaaaatcgaataattaaaaattaagacccacatcaaacttatgccagaattccaactccacatctatgaatgttaacaaatgaaccaaaatttacaaataaaatatgaaaaaccaaaatcacctaaaaaactatacaagaaccgaaaatacaattaagcccaaattattaagggtataaataaataacattgaagggaacagaagcatataattctatgattcccgataatttttaatgcatatgaactattaaggtttcaagaaagctgtcacacgagacctgtagcaaacagtaatttctcaataattggatgtgttgaaagaaaaactagaatcatgctggatagaaaatgaatttaaaaatttcaaaacaaaagaatcagacaaaataaatccataagcatgttggttcctccatgcaaaatcaggtaaggcttgtgaagggcttatacatgactagaaatgtgctaaagaaaagcagatatcacaattttcatgctccaaataaaattgtataattcaatgttctctgatatcaaaatgtaatatacaggtgagaatttagaacggaaaaattggtatatctcacctaccaattcttggcttagtacattatcagttatcactaggaattaccaagtttcttatatagcaacaactaaatgttctctcgggtaaaagagggagggataaataaactttaggctcaaaaatttaataaaaaaaatagaaaaagaaagcctgcaattagcacccttcaaaatcgttagcaccaaatatccccaccaaaaacatttactaattttcctttctcattctttggccacatttttatttacacttcagatcaggccagtgttcatacttcctgcatctgagcacaccatgtgtgcatatgaacattatcgcaccaagaaaattttttccagcctaaaaattagagttccaattgatttgtgtaggctgaggctgctgataagatcctgaagggggacctacagtttcaacgggcccagccacagcctgagactgttgcaaaagggttgaaggtgaagctattgtctgccctgcttgatagataccagcaaatgccccatgagcagcctgtgttggggggaaggtgagatgttgtccctgagggctaaggttatacagagaattaacttgccaactggacatgtcttggcctggagcaggtatccacactgcagagccttcactctagcaaaaaaaaaaaaaaaaaaataatatgcttaggaactccagaaagtccaagaatttcatttcatgctgatgaagcaaacataaactcttaacaaaataagattgatactattgaaaaccagggaccaaaatatggaacaaaatttcctattttatcaataaatatgcatgggtgaaataaaggacattaaaaggaagtaaaccaaccagctgtcctgttgtatagatctggttttcctttaactgagacactaccagatcatcatttccagtggagcttccagtattaactgtttgacctggcgcatatcctacaggtggagtgataaatgatccagaaggaattcccatatgagctgtgtttcctgtgtttgctccagccttgaattgagggagagggaatttgatcccagcagctgctggtagatacatgctgccagcggatggttgttgagggaaaccattgtggtttaaaaattggtgtattggagacacataaattggagggtaatagtggccatatgggaagaaattagcagggtatggtggcctgaaaatagaaaccgactgtggagtcacaggtatagaattctgcaggggtggagttgggctaggggacacagcctgagaacttgcattctgcaatacaaagtaaaaataataaaaaaatagaatcatataaaaggaaaaaatatacagtcataataaataatatatgcacttgcaaagaattttacattgtcatccaattacaaaccgctatgtatggtaaatttattgacatttacaataactaccttaaaagtcatactaagaataatttactttttacagatgttaaacctttttaactttttaaaagtttatgaatggaaacctttttacttgaatgagtaaattaactttggaaaacaaatgttaaccttttactttttacaagttcatgaatggaaagaaatttaaaaaacaaagggccaatatcaaaacaccaaaccggaaaagagagcattcaaacacagggagattcggttttaataaatattaagcagaggaagatcttaggaagtaaaagatggagaaacttacaacaaagttaggaaggcgagatgtatcttgtgactgaggttcagttccctcaaattgaacttgctgagtgcctaacatggaggaaatgaaattcaaaccatagttttgagcagtttgaacagtcggaatttgttggccttcaggagccaacaaaacctcctttgactgatcaacctttgtgtcagtaccagttataggattgccatttgtagctggtgtcttttcaatcaaataagatgaagaatgtggataatcaagatgatctccttgtgcagtcaacgatgcactttgattgctatatccagacaagaaataccatcaaaacaaaaattacatgagcacaccatgacacaagtaataactttggtaacaaagaaaaatcaattaattcagccagaataattcataaaagaaataataactcagccttatgattgacaaagagcacggaaaatggcatagtattatctccaaagagaaccttcccactttcctagtactatctttctggcagattatagttgttttgttaagaagtttgatataagagaacaaagctaggaaattacaaccattaaaaagggcatgagggaacacacgttcacacacacacacacacagtcacagagagaggggtctgttatttgatatgcaaggcaaaagcacatatggagcagatgaattacaaaccttgaagttgcagcttcttcactcaattcaagggcaggagaagcattattgtcaccacctgttccactgttggacttttcacttgggcccaaagtatcaaagcttccaaacgtcagaccactttttaaagccttgggtacttggaaatggtttggaaaagtaacatgttgcctcaactctgctgaagattgcacacaagcttctgaagttgaaacctctgtggtattagctgtttcataaacatgtatgaacacgccaaaaggcattataagggatataattagagatatattgaaaagaattgagagaaaaattgtaagtaaataaataataggcaactctagattgtcaggatgattccttcaagcatggaagagtatcaaagcaagtaaatttgagggttagcacacaaaagcaaaacccatacaagtggcatgcttatttaaattatgggcttagtcatgctgcttctcacttaaaataccttcagaaatagtttctaaggttcttctcctgacctatgtcctcctattcctgtgggcttttcttcactatctcttctgaaaatttacattgtcctcctttctagtagggagagcaatgatagtatccatatggtagaattgtttgattggaaaattcaaggaatacttcaacccagtacattgagggaaataggacataaagcaaccctgttactcataagattaaacagatataaacaaaactttacctagaggtgattggctaccagaactggaagatggcctcaatgaatcatttggggatggagatgaaagttgtgagggttcagataaatgcttattttcaacttcatttaacttctgtggggcatttgttttgcttgttgaattcatggacccatatttttcattcttggatgccgataaatcattaacttcatgaacaactttacttcctttaacatgatttggtccggcagatattcggttgctcccaacttccctactaatagcagcactgacaccaagactccgggagacagatgatgctactacaggatccaaagaagaatgaacatcggatacagaagtttgaagttgatcagaacttgacacagactttccttggtcagtgctggtaactgagccaaaggtttgagtagaggaggaggatgctgcaacaacagctgcatgaggttggacattttcttgatggccagtgtccttagcagctgaagtacttttaggaacactaactatgggagattggccagcagaatcatggcctgacttcccattggattgatttgcagcaccatgttgagctgaaactctgcaatttaagaaaaatgattttgaagaggatacatatatctaactataaaaaagaataagtaatcaagccaatagtgacactggtgtatttctcatcacaccaacaaacaactttatataaatgtatttagcaatccaagtgtacaatcataagatataagatgttatcaagttgatcatgcaagccaaacttcaagcaagttgattatcaataaataatcaaaaattaagtatcctcttacttattctattcattgtaattattattagatattgaagttatgaaataaaaaaagagtacaatttgatgtttaatcaacataaaattttaagcatgacttgtgagatttggttagaattttaggcacaaaacaggaaaataagagtgatgtcatctttcacctttctttcacttcttttggagtcttgcttttcttttttattaaatacataaggaataaataagccatttctttccaccatacattttctcataatcaaaattaatctggtgaaataaacaaattaaagcaaatataaaacgaaattgctaccttgtagcttgagatattgtattagtcttagttttctgtgaaaatgtctgagtagagggagcatgacttctctctgcaatgtgattgactccattttcccttcgattagcttggttcctcccaccaccaccatctaacaacagacatcaagacagggtaacaacttacaagtcaataaactagtagaaaatttgatgatgcttaggacaggtctctgcactaaagcagttcatcttataaaaataatcaattaaaaaaaaaaaaaactaaaacaacatcaaaggattaatagtggcaacggaaaggtactttatcatgacatgctggattcaaaaggaatgtaatagggctcattaagcagcaaaataaaagcataattcttaatattcagataaaataactcagtaagaaggtgatgggaggaaaggatcacaaagtgataatatctttaaaaaaaatatggcattccaaaagtatttttctttcaagagacagggaaatgatggtttccaggtaaccatttgtggaaacgaaactccataaatggaagagacaagtaagttaataacaaagcccaaagtcaaacctctaaaaggtggggaaattgtaccaggaaagttagaagaatatcctccagaaccaccacttccccccctcccttgtccgccttgctttaacctaggctcatcagaagctctgctgctcaatccctgcaacaataaaaataacacaaaatactcaggctaataaaaaaatattaaggagaaaaagatgggacaatgcaagcacatttacttataactggacatatacaattacagaacacacagaaaaaaagtaaaaaacatatacaggcaattataaaacaagacccaagtcttttactctcagcaaataatatcacatgatcccacacttcatcataggcaggaagtagaaacctataacaacctcaactgttcaaacattcataaaaagaaaggattcttatagaatctcaacatggagtctgccaatcacagtgctcataagatgatacaatggcaactaatgacacaatgaaagcttgcctagcagctcacaacaatcaaaataataaatacacttcaatatagtggataaacaggtaaaagattcatccactacaattgatcccctcaatggcagaagaagcaccaaattaatccgattcagcaactcaactttcaagagcaagtaaggagggacgggagaatcttacccccttctttcggtcacgtctccttctcacctcatgaaaagtatctgtgaacaaaaaaaaaaaaacactcgacattaaaaagagagagagagagagagagaatctcaaatatgccataacacatttcttttcaagaaatcctaaatgattatatagtgttgaagccattagttaagaaacacgtgtgagcgagagagcctgagagataagataccatcaaacaccaacaatatcattagattattattatattcaactactatagctaattcctcgtcacataaacaaaaccctacaaaggtactagcttttatctccctgaagcgcactgatacacaatctccttgttgttcccaaacattgaacaaagtttcaatgtccaaagagccgcacacacagacgcagctcccctcacctcagcttcttacaataaatattttaaaaaataaaacatgaaaagatgaagtgaagtttgagcaacaaccctaacaaacagagacagtgaaagtgaagcttaaaaagtgggggaagtaggggagagggagagagagggagggagaagaaacggatcgcaaagaagataagagacctaaatagagaagcttctgagcggtctcattgggatccatggaacattcacggaggacggcgtagatttcgtcgtcggtgtgctgcttgccggtgatctcacggatgtcctggatgattttgcgtacattgtttgggatcggaaccctagaattcgaagacccaccaccgccgctcatctttctgtaacacaccaacgaagaaacaaagaacacactgtctctgttccccaaacttatatatttttactaatacaaccaaaacacaacacagtcactttgaatcattaatatactccatttccattactatgcctattttttattttaaatttaaataataactgcttcaaaatctcatctattctatatttgtttaggcttaaagaactgtaggtcctataaaatactttctccatcatattataattattttatcttttcaatataagattcattatttattcatttatatgatattaatgatatgagtcagaaaaatgaaaaataaattaatgatgataacattgattttataaaattaatatttttttattaatttttcttaattaaaaaaacaaaaacaataattataagaacatctttagtgttagatcttgaacaaagatcttaagcttaagatctgatcttcattagatctcccaaataaagaaagtggagagatctccaacatcaactgcacattgttcaaaaaaaaaattctctctcattttctctccctaaaatctcaaattaaaatttaccattatctcaattttagatctaccactaaaaatgacaaatagcataattcatcgtatcaatcaataaaagtgattaaatttgttgattttaattaataatattataaattttaattttattccaaaattactcataacataaacttataagtgattgttattttttaaaggataaatattcaaactaattaatataccttattttcttaatagtataataaatatattcactttcatgagaattgagtatatatcactgaatctcacaaaagattaaggataaaaaaaataacaatcaatacactttttagatcgacattaattaatgaaataatagtatgtttcttataattaaaaaaatgttattttttatttcttatataaaaaatatattaataataaataaagattaaagtcttcatatttaatttaagtgtcatatttaatataatttttaatcaattggctaaaaaattgtattaacagaatattaaaattagattcatatgtatatgaagagattaagttatacttataaaaatacattaattgttataccatttaataatttaaaattgtacaatcattttccaaaattcactaaaaattcatttcacattaatcatatttaggaaaaaaattattaatactaaattattgtataactcatttatgtacatcaatatttatttatatgtttaaaatatataaaatataaattatttgattatctttttattattgttcaatttgaataaaatttataaaaaaaaataaattttgagtctcgtatgaacttgaattattaaacataatttaaatataattcccttaattatacgataaagagtattatcattctccttaacgatgtatttgtatttttcttttgggatagttccgttgacctagtgacaacaatatctcaatcatcaggatggcttttgaggtcaggctaaccaacatggcttcttgaaacgccatgcaacaatactagaactaaaaaatcaacttgtcaaatatcagaattagagaaaaatatatgagaatcataaatttttacattattaaggtgtgaaagagaaaagttcttaaatcataaaaattatttttttatgaccaatttcttatgaaaaaatatatttgttcactttagattatagagattctatttagggaaagatcctaaactggatcatgatggtaattttggtgcgaagcatgatgacgagaatgagatcatacgagacattggatacttgtatagactcttattttaagttaatatggacttaagatggagtgttgtcttagttatcataccaatgtttgctaatttatataatgtttatggtcgaaaaatcaattatccaattgtcattacacacaggatgtgtgccctaaagaggagtgtcacacgttcaatatgaatatcttcttagtttagttgataaacttgtttctctaggaggggttatgatgtccttgaaagagattgatataggtaagaacgaacactcgattattatgatgagttatgcaaatatcacaattcgcatggtatcaaggtcccacttccatatcagttacccttaagtcggtggcttctttgtagaaactgttggcttttatgcatttaaagtgatataacccatttgtataaattggattcacacgttattattgagtataactcaagttcccataatattgagattcctctttcagaataatattaatcctgaatgaccaaaattttaatgaatttattcaatccttatttaagaaaatgaggggaataatttccaatacttttaataataatttctcttgtattcgattaaaacagtttcgtataataatattgaccaaaaaataattatgtttttgttattattgtgagacaaagaaaaaggacacatatgacgtataatataatattatcataaattaagcagggttattaactttaacgtaaaatttaaaatttagcctattaaataatttaaaaataataaacaaaattggcgaaaataattgttgagctatgaagtaattggactcaattgctaaagcccaaaaactactgactgtcaaactgtagttactgagtgacaagttagaattgtgggaattgacaaagtgcgaagtacacaacagttgatagtagctgattgtggctttttgacaaagaaggggtgaaaaaattaattatcatttggaagaattttttttataaatattatcgaatggaagtaaattgtataagatgttgcgacattaaatttttttataacagactttaaatttttttattataatcataaatatatttacaatttaagtcgtaaatatatttattatttctattttttattattattataagtcttaaatatatttacggtggagtttgatgtaaacgaattctgaatcagaaatttaagacttacccattcgataatatatttaaaagatgcccaaatgctaattattttttttttaatcctttttgtcaaaaagcaactgattgcatctgcatctgtttgtgttcgacagaacagaatagaacaggaacctcaaacctttgtgtcgagaatcttagccatgggtagcaacggtttgaggtacgaaatcgcacaaaactcttacatcaaactcatccttcactcactcaaaaatccaacctgcgccgtcaacggcgtcttgatcggtcgcatctccgcttccaacgacgtcgtcgagatcgccgatgccgtacctctcttccactctcacatccctcttcttccccagttggagatatctctcatcatggttctccctctctctcttctctagggatttatcattttttttttccattcaattcttaccccatattgtaatttacaaaattatgcacaaagacgtatactttcttaatcaacatgcaacctaatcaactgggtttatctttttttcttctgggcatctattgattttttgtttgctttgtgttgcctgtagttttctgatttttttttaaatcaattttttgtgtgagatagatagaggaatatttttctgctaaagggttgaacatagtgggctattttcacgcgaatgagagatctgatgacagtgagcttggtggtgtggcgaagaatattggtgaccacatatgccgctactttccccaagccgccgttttattggtttgttgttgattttttttttttttttttttgctaattttgtttttaattatctccttttgtttatcgtctttctgtttttattcaattattcgcagttagataacaagaagcttgatgctttgaaaaagagcaaggaccgtagtgccataatgcaggttagcaatttcagtactggataccgctttcatcaagatcaataatcattgtgtttatccactccatgaattgtatttgggcttctttagatgatacatttgatcaaaccatcaaatgtatagaatagaaaccattctgatctatatgaatatagaaatcctcaagggcttttgtcagtggactaaaataaccccttatttttaatgggatcatgaaaacctgtgaactcgttagaatatgtatattttctgcagtttgctgcttttgcattggacagttaggagtttgcttatgttggttggtctgactgtcttgtttttgtggcttattttggtgcatcattctctaaatttagacaaaactgctgtatctaaaaacttaactagaaatagggggctaggatttagatatgtgggtttcattggttgtaacttggatcatcttggatggctagaattcaaatttcaggcttaatgtcatgcttcaatttctcttgttttcatcatagctcataagtcagaagagaggaatattctgatagggactcagatattatgaggtacctaaatcccacctcaagtagtatgagatattcggtgaagtactcaagtggcttggttctctccccccgccaaccttttaacagctagcttttaaggcagggtttcccaagtgcttgggtgcttatcatattcctgtttgatttgccacatactgcagcatatttgggagccactcttttgggggagataatatttttgtcttttttccaaaagttctgtcaggaaagttagcaaacaaacaaacaaaaaaaaacttctctaaaataagctaaaccaaatatgtactaagatctatcctattccaagagtgggagaatgaaataataatgttgtctaacgtgcacactttgcatgattatacaggctacaacctcaaagctataaggcttcatccaaaattcgtactaattataaagattccttgtcttttgtttcttagtgttacaaatcttatggttctttcaaaaacactttttttttttgttataaaagaagaaattcattatctgcttgttatataagtatggttccaacttcctagagtttatgctatatataatatacggttcccccatatataaagtcatttttttgttagttacattaaccaagattgcctttttcttatggtttagctttatgttagggatacatctaagaactggaagttggttcagtcagatgggaacaatcgattctctctcaaagagccatcagcaaatctagtcttgttggactatattgcatccgagaagtggaatgacattgtagattttgatgaccatctcgatgacataagcaagtaagtgctttttgcttgcagtatttctttctttccatagtattttatttatctgtgcagctataactgactaagactttacataatacatattctattgttttcagggattggctaaacccagggctttttaactgatcccggcccttttgagtccatttttgcgctatttactttgcaagtggaggatattgaggcttattatggtgtatgctggattctcaatgatggacatttagggactatattttgaccctaggaaagttgcttcatgaaactttttcagttgtataagcaggatatttaccacccgttcgtaaaggattttgattgcagagcctctctctcttttattccccccttggatgtaggtatatttaagtggatttttttttactctttttttgtttgctttgtttgtgagttgtgacgaactttgttacttggtagaaacaacaaaaccatcactgccattatcttagttaatccaatggttttcttatgtttttatggttgcaacgcattctcttttcagatttatgtttttattcaaaagataaaataaaattgggctgtacatgacaaagggagtgggggacagttataaatgattacgcgggcccaaatcattgtctgaggtgattatgattaatcttctgaaaaaatgttccttttctgatcaatatgaagcgtacaagtttgagcaggattggtaagcgtgtgatatgcaagtagtagcactaggcaacaatgccaatgatggtgaggatgtttttatcaaatcggtttcccactatttcagatgtctgtggccaccgtgagtttgttgtgtttgaacatatttaattggatagaaatagaatacaacaatgatcgaagtcaaacaaatacttaatgcaaacaatttgcttgccctgctaacgtaaaacaatcagtacaagcttgttcaactttctgtttatacaatacaactcgcttaattttttttttgtcttgtacgagtatttaatttatattttataatttataagaataattattttatattatttgaattttaatatattattaactattaagtttaaattttataaatatatgttaatagatatgtcaatagataatttataagaagatatttttcttagtcaattttgttcctaaattgaacaagaaattatcagctaatattcttctcttctattgctcatgtacacaacctcaagtcctcaactgttttgcgctgatcatggcttaacattcagtacaaattcttctgccaacgactttcaagttttcaattctcaaataaaaaacccatcagtttctgaagactctcttataactgctactacgcacgataatacgtttcattctttgagtggaactgttctcttctctcactcacaccctcttcttcctttctttctgtaaaactcccttttccttaatttcttgctgatagtacaaaaaatgtttacaacaaaataccatatgatagcagacatctttgatcgaaacaacacaccataatagaactattatatgatcatgtatcatcctctattatatgcttggaagctatgttggtgatatgtcatgatagaggtgaggacttgaaaaaaactatgataaagagtacaacaaattttatgtttactaatttaagttttctatttttcttttttgttcgtatgcaatgttcattatttctctcttatttgttttccttctctctcttatttctatatatttaagatggccgtatttgactatctcaagttaaaacattatagtaactaatatatcttaacttgcaccaaaatacaccgtgttcctattatacattctattacttcaaattttattttctcatctaaattagttattttttaaaaataaaaaattgttatcgctttgtttataattcagtaatttttttaaaaataaaaaatgctatcttttgtttttaatttagttatttttgaaaaaaataaaacctgagcagtttttctttttctttttcttttttacaacaacccgagcacttcctataattatttgacttaaattaaaattcaaaacaaagaaaactcgacagtttaaaaaaaccccgaaaagagtgtaatgaagactgagaattttattttaaaaagttaatacaagagagtaatgagttgaaatttcaaaattaaaaaaattggcaatttttaaataacagtattttggaattttaaaaataaaataaaatagtcagttttcaaatattaatggtttattttatgaacaagaatagagtaacaagctaattttggaattttaaaattaaaaaataataattagttatgtcttcattcttaaaaatttagaaaacaaaactatttcattaatatcccatcgagcaattaaaaaatatgaaacaatttaacataaaatagatattaactaatattgttgtgaataaattttcaaaaaagaaatcaagaaatttatttattagattcaatttggttcctttatttttttaaatatatttaatttggccatttatttttaaaaaaattaattaagttttttatttttataaaactgatttaatttagtggtattttaaaaaaactgactgcatttgtttaaaatgtttgaagttaacaaaatgaaattagagcaaattaaattgatacataactagagttataattaaaccttttaaaaaaagattaaattataattacattagatgaatgaatggatgatggaggttagagaatacaggtcagagaagaggacatccatgagcaattacgcctggagctgtggggcatttggccaaaggacagtggtcatcagcatcttgaccccaccatattggaccaaaaacaccataattttgaagggcaaaatacagaatgacacccatgaaagcaacgccagcatctaaagcagctgagaggatgtaagtatatctagcccaccatgccttgaacttactgtaaacgtagaaattgaagaagattccaacaaatccccaagttatgtagttgacggatctggctggtgggatgccaccaccaccagcaatgattaagggcatattgatgagctcaatccacttgtggtttgggaatttgtgagcaagcagccacactggaacaggagcaagtaggccaatgaggaaaaaccaattcatcccagggtaaatcccatccttggtaaacattctctgtggtcccactactccccaaattattgaagcattgtaaaacacttcgtcaccagggcatgtccatggactaccagctggcaagtttgtttcatcacatatgtgtggaatacttgtcagaagccaccatgctgttccaaagtacacacctgaagcaactatggtacctaccaactgaacacaaaattaactatttatttgtttgtctgatcacttttgttaaggagaaaggaaacatgacaaagattgcgagttcaatgtctttggctaataaaagtaacattctaataaaactaacatttactgatttaaaaaaaaaaaaagttgtttagatcaaccatatatgcatgcatttacatcctatcatatcctatacctacctgcacaacgaacatagattttggaggaattttcatatagtggcctaatttgaagtcttgaaggaacccgagtgcttgtgacatgctgatgtacccataagtcttgaaggctacattagcaagtggccttcctgggtaaatgtacccaattattaactctgtaatcacgttgagtccgacttgctgcaaaacaagaaaaatacaaccttttgaaagccatacaaaacaaacaaggcattgttgcattttgcatgcaaaacacttttgtctacttggacaatattggacgttaccgtgtttgttgttgcctgaatgaccccaattggcaaagtgaaaactaacgcaattaccagagacattaggactccccaccatggcaattggagttgcttgccaaagccttcacaagttatcaaagatacaacgatcattagaagcaaaatgctaacaaaccaccattcaggtacttgttcatagtttctcttcataattctcgtgtgcacatctccaagttgttgtccttttagtgcagaagttgtcttcttccacatctgataaatcgttctttcaaatagatagccacaagcataaagttagatggtttattataaaaaaaaaaaaaatgggaatgtaaatttagatacactggtgaatgatattgttctgcaatcaaagttgaccaagttgtattttatcttaagaatcactgccaacctttgaattggagaatagtatcatgagtaccaatagataatacaattttataggtgttttagatattatttttcaatcagaattataatttcacctctacaattcatgttgacatttaatgaaatcttttattgcatggattatcgaggtgaaactctaaatccagttagaaaaacaacacaactatggaatatcatctaagttttatccatggtactatatttaaattatatcactaactaaacaaagcttactttccatggaagagggcaacatgggcaatagtagcagtcagagttgcaaagctcaatccatagtcgaatgcaaatgtgatactgagatagagcttgctgtaattgttataattgtccatatcaatgtcaaaagttttagcattcaaaacccgagtgacattatatgttgcgccagaggaatcaaatgtgtgagaactgatgatggggaacttcttggcatcatataggttgttccaataggaaatgggaaccagaacatacataaacagcacaaatccaaccagaatattgatgatggcaaagccaggaacagccaaaggactccccaagaagccagccaccgtgttccagtccaagccaaatgaaccaatgccaaggcctttcatgcccgaaccaatttgttgtgcagtgatggagtttttccaaaccaagcaaacaaaggagattgttgttattgcttggaaaaagtagcctggaataacgtaatatgcaaagcttgctacaaagaccaggaaaaagaattgcagccttgtgtttcctcctttaggccttttctccttttcatgaaatgccctgtcattatcacaggcagaatattccaaaattaaaagtttcatataattaatccttttcattcacatatccaaaaaaataaagacgccaaaaatcaccaaacaagaaagaatagttaaatttaaatacctaaatagagacacttgtacaaggtttgaaggccaccacatgtacggggaatctacaagacatttcctgaaaatcccagcccatccataaccaagcatctaaaaattcaacgacaaggtttagcagactaaccatattttgaaaaatgcttgttattttgattaatagccttaaaagtaaaaacaaaaacgagtttttatattcgtatatttcattttggaaaatgctctttagtgcgaaaaatatttcgtgaaaaagttaagaagagacttcaaataaatataatttaaaaaatcttttcacaacaaccccgccttgtatgattatgaatccctacttttcgtaatctaatttttaaggtgtttttcatactaaatagcattgttgtttcattttcacttttttttttctttcttctatttctctcaccatctcccgtcacatcatttatgagtttctcacttctctttttcacatcattgatgtttactatataataatgaaatggtaatgacctgggtggaaagtgctaagagaaaagcggcaagtggatggatgttcctgtggtagaaagccttaacaatagtgacaatgttgatggcataaacaccactagatccagcgctggcaaagatggtgatgagtgcatgttccttcagattgaaggggccagggttcaaggagaaagaccacttggtcaacggaacacgaattggtttggtgggaagtgttgctgccatgagtttcccaactgggagagagagaatctgtgctgagacggaggagatgtagagagggttggttctgtagccgaagaattggttcacaaaggagaggataatgcatgaggccaaccccagagtccatgttctgaatgtcagtgctggttgtgttgggtcgtcggttgttggaacggtgagcctcacttgctcaataggagactcatctacctcatcactttcatctgcaacaacaataccaacatataagattgattaaataactaattaagaaagaaaaaagaaaggaaaaagattccaaattcgatctttttttttgttaaaaaaattacgacaacaacacatacaatacaatacaatacaatacaaacttcaccgtatagctatgttgaagaagaaaaacacacgcgtacacactaaaaagcataaaaagggcaccggcatacacaaacaacaccacaaatacaaattcaacgtggctctacactcttgtctatgatcaagagagagaatatgttaataaatattcaccaacttcgataaaattacaagttttctggatgaacttgaaaaattctttattgcagatttaatttcatgaacaaactttaaaaaaaaaaaaaaaaaaaaaaaaactctacattaaaccactccctttcacttggttggtgatccctcttcaacaacaacaataacacaaaaaaaccaacgagacagaattatttgttggtaccagacaatttcacgcaagcggcaaagaattatcatggacgataatgttttttgggaacatgtaatgcattttttattcaaggttcaataatttcataccaattaattcattctcatacgcccgatagtaaaaccaaataacatgttacagcatgataatcaaaataaactataatgaatgttaactcatgagtatataagacagacaagacaaggaaggaaatatgttagcaaaaatgaaggggtgttgtgttgggttatttggtgttgtaatagtaccaggtatgccaagttttgagtcgtgctgattgtcgacgaccccagccattgcaccgggatctggttcttgaaccctctctctctctttcctcgttcaggcacgcgaagacctcacgttgttggtatcattttatagggacgtgtgcactaccgagcatgccgttacagaaaacgtacatgtgtgcctggaccatttagtggtgttaatttattcatatttgacgtaagcatgatcaaatcaacaatgtatattactaaatatcacacgagataaataaggcggattttaatgttctatccttttattttagcaaatcttgtttatgactctaagagttgaccaccaaaattgattctatatgctctaaggagtaaatagaatttgactctgttctctgatctgtcttattttttttagcccttctcttatgaatgagttggcatagtagcagtttgaaataattattttctttgaaaaaatacacatgcatatttattttattagggactcatatgcacaattgatatttgatatattagtcttcaataagattaactagtacgtaattaatgaccgtgtgtattgttcagattattattgttaatttacaaaagactgttcttttcaatgaaaaatcaatttaaacctaattaatatatcaatataataaatatgtattgaaaatattctcctttcctttttattgtaattttaaatattttaaatgcggttgttttttttattcttaatgattttgttaattttgttaattttgtttgttttaagagaaaaatgtatttaataacccagaatctaaattaattattgtttgtcgtgtgggttaacgggcacaattatcaatcatgttttatactatatatatatatatatagagagagagagagagagagagagattgatgattgatatcatactagaaaatgagaatatttaactagatgtatggaaaatataaagaagggtttcataatttaatagtttttttttacataccaatactttttgatttcttattttttctccatacaaaaagcaatcttaatcttagtactaccatgcaggattcagaatttgatatctcaacagtttgtttaatttttaatgtctgtttaaagtacatctaatgaaaattaagcactacgtgcattttcataaaattaatccgaattcttttaaagatttgtaaaacggctgccaaacttgtagttttttaatattaactttcaaattttgaatgaaacttactaatctccgtaaatgtacagtgtacctgtccgaatgtaattttttaagtgaactatcagtaggccgagggggtacatatataaaatacataagcttaaattaagtttttatattaccaataaaatgagtatgtgtgagctgaatatcttatggagaaacagcagaaacaataaaatgaaaaatgacatacattacatgatgctacagtttgatttcattggtaatatgacgaagtcgatcccaaagctgagtcctctacccgctgaccttccttgccatctagctttctggaatttgtgattctctttgatgtttgttaagcgattccaaagctgttggacaagaaagaaagtggacttattcaacaatgtataatgaatggaattacaatctggtaatgaaagttagaaaagaagtacccacttggctgcattatcagatttccattcaacaccattggggtccatgccaatattaatggcagtgaactttaagatgatgcagggttcagagataagactgtctaaggaatttccattttagtgaggggagaagctatgtaccttctttcgctcgcgatgtgcataggtctctaactggttgaagtgcataggcctctaagtggttctcaaccgtcatggacaaaattacaaaaaaaaaagaagttaaaatatgtacgtgatttgttaataaatatgtgaattttaaatttattttttaataatgtttattttatttttattctttgataaaataaaacatttatttttaattttttacattttttagttcataatatattattaaattttgtgtttatttttttataatcttttttattatcggtttctctttggaaaaaaaactaataataaaaataaaaatatcaagaaataaatacaaatttactatttatcattaattaaaaaaatgtaagaaacataaataaaattattgttttatcatagacttaatgttaaaaaagtattaaaaataaatataaaatttaaatatttattagagattaaaaacttattttgaaaaaaaaaatcaataacttgaggtttttagacacctatataataaaacgaaaaaacaatgtataggtgtgtaaggatcaaattcttaatttaatcttaaatgtaaatttgacaatttaagagcgttgtttaatatttaaagtacatctaataatgattcttaataacattcataaatgatgctgacaaaaaagaatcatatatgatgagactttttttgtttttggtaaatataaattatgagacgtttttgtttatcacaataacgtattgcaaacagctggtcaaaataaatttcattttaggaattatacttttatttaatgaacaaaaacttcacgtgccaaaatgtggtataaattaaacctgcgaaaaatgtatagttgaaggaagttcacatagactttcttttacactcaacaagttcagaaaactgacatagcacgtgaatattaatacacgtgattattgatacattatcaaatgtaacgtctacagtctactaatgagaaatcgttcaatgtacgttacacccacatggattagttaggtcattacactaaaatataaatataatcatttgcccattaaattaactcaactgtctcgacgataatttttaggttaaattaattttttttactttaatctttagaacatgctatttgttggtaaggttttaaaacactcaagtttcaggtataactttagtgctttttgacttgagtccaagaacattatatgtcttgacaacaatggtcataactatctttagaacatgctatttgttggtaaggttttaaaacactcaagttgctctactgatcttcgaaccatgatggtcttccgaaatctccaaggtctcttttcagcatcttttttggtagaggtttgcgaggttttttacttattgtttctgtacaacaaattgatgagaagcttatactcttaaagaattaagatcacattaagacatgtttattttaccatttgtattcttattttcagcttgaaaatattcatgaagatgttgactgtggaagtggctggaatatgatttttgtatggtgataggtggttcggggggagctggtaaaaaataatgataagagaaaagacttatttttacagtgtgaaacttctttttttggatggcaggggtgtgaagatcttttgtgagggtggcatttaggcgaatatgtggcaggtcgtgtgtggtgtggctgttggttgagagcagtatgttatttcttctatactgcattaaatataatcagatctcaaaatgcattgtatatttctttttggtctgtcacagctgggaatttttatgtcttaattgagaccttttcttttattcaggtttttgattatttatgctcaagctagtgttatgaaaatcggaccagattaatttatgggatcgttcatgcatgtagctcgatttgagtcaatagtaggattgttcatgcatgtaacctgatttcacacgccttgaactgtcgattttgtaaaaaattggtgacccgatcaggtattacgacctagaaaggattaagtgtagttttttttttttttggaatcgtaaaatgttatctgaatatgacttgcgatcttgtatgtatttgagttgtgttatctaaatcgattttgaaaatcctccccatgttgttgcaagaccgtttctcttcaatctttcacccttttatttgcaaaaatgagatgtcgaagccgctatgaaaccgccaatttgtgttgtcgacgagaatatctttgttgttgcgtagccttattttactctacatttgcactttgatttctctagtgggtaacaatgctaagttactgtgtaatactgtaataggatagagtctagggtgccacacccaaactccttgtgcacagtgccaaagccttttcaaattcccatttcttctacttttccaaatttatccctcttcttcttttcccatcttcttcaaatctagagtgccccctttcatatgatctccatctctccacacaaattagtgccacaaccaacattgtaactatggaagaaggacgaagaaggatcttgacgacttgctcgtgaccccctatctctacgttttaagttttaagaggcattgtggaagggataagatgttgagaaaaagggagcatatgatggaaaagaccgtcgatgacgtcatttgcgatggaaggaactattctttccctggacgatgacgaggtaatcgtcgtctcaccattgatgatggttttctgattacaaagataataggtttcagatctccacatgctttcgcatcatccttgaacaagactttcgtatctacaattattttgtgtatttttgtattgatttcctagatcttaacaatgtacacattattgtatagatttgtgactgaagatctgaattaaattgcacatatgcatgcaaaaaattgcacggacgcacacaatattgcacacaggcaaattgcaaacacgcacacaagaaaacactaggaagtgagttgtattgttagggagttttatgatgtatgggaagattaattgggttagtttttctgccctttattatttcttctcggagagcctcatttccctaacatatgttcaaccctcgaccaaacactcttgagatgaatgagtcatcccacatggttccaccattttcataggttatggttgtaagaccccaaccaaacccaacttaccctaagaagatgagaaagacaatttggataacatataacaaggcaaaaatgacctttttggcaatttatcccttatatctagcatcgacataaggcttccttccttaagcatgctcttgtgaaaaaacatatgcttggagacgaaaatggggctctccagtatcttatggtcgtagcctatgaaaacgacgggggccctgtgggaaaactcatttttctcagatgtgtttggtcaagcccttaaggtaggcttaggaaatggggctctccggtaagttggatttggtcggggtcttatgatcgtagcctatgaaaacggcaggaccctgtgggatgacttgttcatctctagagtgtttggttgggggcttaacgtaggctagggaaatgggattctcatgtaagttgggtttggtccgggtcaaatcgaaatatgtcattgggtatttgaaaatgacattatctagaccaatgctaattgacttcaattgctaatggaaatgtaagtaggctcataattttagaagaagccatatgttcatgtaataatcacacactaatgagcctgtgtttgtgagtgtgcattatgttagtcgtctcatgtactatgacctgtttaatataactatatattaaaaaaattatgactcatcaacctttattaaaatgtgtcttcttgtgcaaatctttcatattaatatttttaacttgtgttaattgtgatataaagtatgactcgttattttatatatgtaaatgtatagcttacattgattctggtgcagataaaagtaagggtgttcatggctcggtttggttcgatttttaataaaaagtcatccaaaccaaacttaaaaaacacgtgattcgattggtttgattttcattaagatttatatattttcttttcaacttttaaattaaattacattaaaaattgctaataacaatctacgaaacttattaatatgttaaaccttctataataaaaatttatcaaattttcatcaattttaaaccaaacatattttaaaaaaagacgtctaaaaaaattgatatacattgtataaattcgtatacataacactacataacattgtgaaactcaaataacatatacataaaatagataacattaaagtaatataaattttatgatttggttcaattcgaatccgtttcaaaagcacaaagttcaaattgaaccaaactgtttagtttgcgaaagaaaaaacatccaaataaatttaaaaagaatcaatttctttaggtttttcggttttttatttttagtggtttttgattttttactttggaatagtttggatttgaacactcttgaataaaacacactctgaaatccagataggtgatagaatgagcagtttttctgtttcaagtgcatatgaaaggataataattttcaatattcatatagtggaggcttttggaggaaaacatggaagcttaaataccaacatatatatatatggtagcttcaaactagtgagagggtccgagtgtttattggcaaacagctcatgctagattgcctactaagaaggggatcgggttctcctttttgttttcattgtcattccttagaagaatatattttgcatgttctttgtgattgtccttcagcctttactgtttggattcatcttctggaacctgaattcataaatgtttttgatgtgtgataaattctctgtaatagaggacagagaaacctccaaagaagaataacaagagagaggaatcagacaatattcagcatttctatagctaggccaatttccttattctaatagagttgtccctctaacagaatgaccccattcactaacaaactcacataaccctcctccagaatgttctactctgtctatatcagtaatagatatattcagtctcacacagtttggcttaatactcctcttgggcctatgctggacttcctcatttttgcatttggggcacaacatcattgatcatatcagttttctttacaattggattaatcttaatcttgataattttatgggaagcaagaaagataaatgttggtctactttatgggcggttgcttgtcacaggttgtggacttggagaaataaacatgtccatgaccatgacccttcatttgtttgaccttataaacctttgggagattattacaacggcttggaaggagtaccatgcaatagtttatatcagttgcctcctgttcagcccaagagttatacaaatatcagatggattgctccatctcttggtaggagggttactctaaatacctcggtgaatgggatcaggaatgacagtggaaagtgctttggaggatttgctaggaagattggagttaattaatatcaagaatattgcggaggtcttagttattcagttttaaagtttgttaattactatcaggatccagctttcaagttcaatcttctgaaagtaatatatttgttttaaacataactacacctttggatgcgcaggtctttatatgaaaaaatattacagtacattttagtccttatagtatgaaaaccgtttataaattgatctttattatttgtgcaggttattgtgacatttgactttgtcattagacatggtgatgtatggtaagatattttagttgatttttaatttttttattaattaaaaaatttgtttgattgttagataaatatttttgtaataatttttaattttttaaaatagtattttactttttagtttctaatttttaatatatttattcaatttcatattttaaataaattataattttattattttttatcattttatatttttcaattactaatagttagttttatcatacacttgtaatttaataaactaattttaaaattttcaattgtttttaccaaatataaccatcattttttgtttttgatacttacatcatctttagctttggtctttaatggaaattttatattttttgttttgatctttatatagaaaaaaaataaatatatttttcgtcattacaattttttattttaattattgcaaaatatgttttttgatttttcatctttaaaatactttaaataacatattttttattgtttaaaatattttttactgtttaaaataaatatattttataaatattaaaatgaaagaaactataggaacaaaacgaaaaaatagatgaaaaatatatttaattaagaaaaaaatctagattttggtgtctacacttgacatatcgtcctttgttttaatttcctatattaacatttttgtggcaccgttataattttaataaactgtagatactcataatttataaacatattatgtagatactaaaatataaaatctttttatgtcggaaataaaacaacaataaaaaatgtcatatacgatgaataagtttatgatataacctagacttaagttttttttttagactagaggccctgaaaagactgtgagccacaaaatttgcttatctcccaaataagtaacaaagcaaataacatagtttagccacaaatctaatcgaagtatctgttgttcctgtagccaagtaacaacctccaatcatccctaacacacattctcgtacccgttattagacataaaagcaggatctgaatacgtgggtatccgtctgaatccaccccaattttaatagaaaaagttcgagtttatcagatttaggttcggatttttcccgataaccaaaaacagggacaggaacggatatgagattacttatacttgcctcacacccgcacctgccctgtaataaataatattaaaaaaatatatattattttgtaattttttttattgaattgattaattttgttatgtaacttttaaattatgactgcatattttgaatatgggtttgttattgtttttttgttacgtaattaacatttttgtccgattttcaataattttttattttattttaatcaaagagcgaggagggcggggaaaacctaaccccaatggggcggggatgagtatgggttttaaaacccgatggagatcggagacgggttcgaggagcgatttttgagtcggggacggggacgggaaatgcaatattcacccccgctccgcctcattgccatgcctaccccctatacctagattttagttttgacgaccactttttttatttattggtaattctaaccggcaaatttcatatatttattttggaagtcaattaacggaaatatagaactcaaaacaaattacttaagttgtacttttggagatgttctaagataacatcatatttttaataaattttttatttatttaaatgttaagtaatataaaataaaaaatttaaatatgaaccacttcaccaaattttctatatatttgtgttttatttaatggaaactctattatctatataaaccagaagaattaaattagaaccgatttacaagttttctttattttatatttaccaacgaagcctcagtttttcattatttaccagatgctgatgatctgttgactttagttaatcactatgcatatcgtgtggaagattaactccatttgtatttttttttttttaaaaaaaactcctttcgtacaaaaaaatatttaataaaattccatcctcatgattgcgatataattaattttacacaaaaataaataataaaattatttcacgtatttattttttatatatattaaatatctcttattcaaattttggttaggagtaaaaaaaaaatagaaagaaatgcttgggaagcaaaaagaaaaagaaagacgtgaaggattaaaagttaaaaggttggggagaaggacatgacattgttgtagtgatgatggaagtgatgatatgtgagcatttgcggtattcagcactctccatcttatctatttcttcacctcgttaccatcgctctataccttcttcttcttcttcgagccttaaaccttcttcttccttttctgtgtcttgctctctcatggagaatcaggagacccacaacaaccaaggccgcagcaaattcatggactttccgttcgtttcatctgcccagaagaatcttatggttgatctcgtctcaacgcttgagaatcgctttcacactcagcttcttccttgcacactcccctctgatgttcagtattatcaaagccaaactgccactgcccaagcttctcttcatattagagcagctcataatgactccccggtaattccccctcttctttctactcccaaaatccttagtgcttgtttggattagccttaacaaaattatttttaaatgaaattgattttgtagtgatgtgatttatgtttggatgttttcattatggaatcaaattatgaataaaacttaatataaagtttttgctccaacgcaaaagcaaagttgccaattctggatcagaatcaattttgaaatcttcagatgtgaaatcaaatatgtaaaaattgatccaaaatcaattatgtaccaagaatcaattcttgtgaaaccaaacacacatttaatttcaatactaagttttcatttttttctctcttttttttttcagcccctacattgttcatgttcccttgccaattatttatcttcccaaattcgttttgacttattttttagtggcttatgggtttctaaatcaagtattggcattatcagagtattgggttgagaattaggtactcaagctactatgtccggattagatactgaagcaaatgggcaatgtataacttttgtctttttctgtgcttcaatgagtaagccatcaaatttatccctaaatttatagtatttatataaatgatccctcaatgattagaaatcatatttagtagtccttcaaatattgaaatcctttaaattgatgaatatccaatactctaagaactatttaggagagagggtaatacttgagagttgagagactaaattggtggtttactcttgctttaatttgaatagcaatggcaaagtgtaaacataaccactcggtcagcctagcaatgaggggtttgagtagtttgcaagagttcctaagatcaaatctcattactgtcattgtacataaaaaaaaaaaaaaaaaagaagaaggaaaagaataaacatacactcgaattttggggtggatatgtgtaaggagaaaaggtccaacacgaacagaaaaaagaaaaggaagagaaagtgatatacgtgattagggatgtgaatgcttggttccgttctcttgccaggtagctactgctgacatttttctccacccttttaatggatttattttgtttagaagaaaaatgatgacatttgttttgttctgaatttggtctttttttggtgtttgtctcagatagattttgtgttgggaagctgggtgcattcaaagctaccaacaggagggtccttagatataacaagtctttcagcctatcttaacagctcaactgatgcgccaaattttgtgtttgaaatgatccgcagtagtccaacaatgctagttctcattcttgatttgcctccccggaaagaccttgtgctttggccagatgacctcaaaactttctatgaggacactcaactagacaaacataggcagactctggagagagttccagaggttcaaccatacttctcttcttccctttacatccgcactgtttcctctcctacagccataatggttcgcgttctgacggaaaatggcggagtggaacgcatggaggatatcatcagggaccatttggaccccatttccaagcaagtgttggggatctggttggatcattgtgcttgtgccaagcgagaggtgggagaggcagaaagagcttatctgaaaaaaagggatggtctcattagaaacaagaccattgagattgatcttggttcaagctttcccagattgtttggtccagaagtagcaaaccgggtactggaagctatcaaggagtactttactgtctgaaatgcaaatttatttggaattgttggatattctatgtattacatccatgtacctaatttgctgtgtaatccaatgaggcctccgtattttctgaatctctctaatcaagtataaaatccgtaaatgattatgatggtttctactttctcccccattattgtctgtgtatcagtaatcagttctctgcttatatatatatatatatatatatatatatatatatatatatactaggtatgattcatatgacagtagcacttatctaattgcatctggttcggtttcaaactctttgaaggagtagagttgccaaacgccacgattaacttcctgaacaagtaggaaaattcttgaattggaagttttttagcatgcttgagagttgagagaagctggtgaaatctgaagtctggacctaaaataggtcaagtgccattcgacatgatttctataaaagaaatgttatatggctcgcttatgatctactttttacgtagctagtgccatttttttaaccaatatttggacacatagtgccatcatatttttaacattgcttacttgcgtttaaattcgttgaaaatgtataaaagttaaattttcattaattcacctcgcttatcataaaaaagaaaggtacatctggcaactcataataaaaattatttggttcgttaattctagaaatgttatgcactccctattaaaaaacttttagctcaaacacagtaaattctggcatcatagttttgacattgagaaacagtaagaaagaagggtcatcaatatttgattcacgatcagcatcagatactgtaaagcacatatataagttgcatggcgaatatcatatactatatgtacgacttatattttcagcgtataataggattcctcacatgttaattagctcaaagctaatcagtatacctactccacaatctttttcaccatatataaagattaaaagccttttaatgattcttggtgatatattttcttttgatattggattcttagtgatattatacctaagaaacccaaatctcaaattaataacgtaaacacgaagcgaaatatgataatggttgctcttggagaaaagagtttccattagaaaggcccaaaatgaacttcatggcagcaatacgtgcatggaaacagaaggcacgaaaaagctcttggagagttgccatatatacggttctagttcctatgaatgagagaaagaaaagtaatgcttattcaaatgtcctctcaaatgcaaacacccaaggacttgtggttgaatttgattggtcaagagtgacatatagttagcaccaagcaatttttgtaactgacacgaaccttttgtttatgataattaagagtttgaaaccattggcaaataagtaataactttgccatgtggttagaggtttttaacataatttcttgtgtattgaaaaacaatgaattaaccctttaaatgatattggtatttcaagacattgttactattcatgaatcttcgaatcatattttctagaaacgagtaaaatctatttgattgattgattataaaaacatttacataaatttcttaaaacttgaaggattacgtgatatttttatagttattttaattatttaccatttaataagaataatataatatttttattataataaaagaaaatctaagctcgggaaaataagattctcacctccatgagaaagtttttgtgaaaaataatttcctgaaatcttattttcttaaaacaaataccaagcacaagaaactaaggtagtgcttaatttgagtgtttttttgttttcatttttaaagaaaacaaaaaataagagtaaatgcatttgtttaaaacaaaaaatattttaaaaaataagcccacaactgacaataacttatcaacatttttaatttttttatgaagaaatgaaaacaaaaaataaatccttaaccaaaataccacctaagatttgcaatctaagattcttagaaaacttaaaacttttttcctaccaaatgaatctttagttaaaaaggagtttgaaatcatttttttctggctaataatttaggtgaattgaataccaggattcatagagtcatacaggtttcaaacataaaaaaatatttacaaaaatatttatatattatttatcaatagaaccctcacatcaacaacaaaaattaaatttatattcttttaaaatataaattcgtttgttatcgattggacgaatctttattggtagtttgaaaccatttttacttatactagagtaaattttgcttatgataattagaagtgtgataaaagaatgagacggggcatgaagatttttaaacatgagaaaataaaataatataattgaaagtgacatctcaacaaatgtagaaaacatttgacgtgacaatgttacatatgaataaataaataaataataggttgaaatagtatgaggtaataagcacaaacaattggaggtacaattttttccctgaactttattgtgaattccatataattgttacatgaacttttttctttcttatgtaaatttcatataagacattacgtttgcggattttttaacttatccatttttattcaaggtgagacttatgcatgcgtgtgactgtgtgaataacactgaggcagtacatattctgatattcttctttcggcagccacaccatatcatttcgttattcggtatatattaaagtgaagtgaatctctctttttaaacaagtgaacttgataatgctgaactatcaaggcatcgatccttaacatggaaaaaacttgtcaatttggcatcatctatcactgtcttaattacatctgcagagtttttcttttctctcttactttcgttttgcattattagtgagcatctctattcttaaccaccgaaaacttcaagcaaaaggaaaaaggttatcgtatatatatatctaatgaaaattaagcactacttgcgttttcataaaataaatccacattcttttccatcttttaaagattcggaaaacaactaccaaactttcaaattttaaatgaaacttcctaatctccgtatatgtaccatatataagcttaaattaagtttttatattattccgttgcacatatattaagctattacctatacaaatagaaacgtccccaaagtccaaacaatcatttattttcctttcctttccgtgtttgtatttatttaacagtttcttaattattatttttttataatgacgatcactcagttcagttcagaattcatagggaagttgcatctaagtccaagaaacttgcatgcttcgtgaagtggacaaaacaaagccagattttatacctttttgtatttcacatgctattgttcattttaaatttttgtggacagtagcttcataaaggagtttgaaagatcattatttcaaaccctagtcacaggttgtcctcaaaacttctcatccagttagtttcagagtttcaatctagtgtcaccacagagataaacagcaacatgtgtattactaatcaggaagctatcaagcagttgcagtcccttatggaaaactgtaagcatttagcatacacttttctgctaatagtgttttgttagtgaccaatatcttctattctttccatgttttttttaatatgtttttctctcgatgtagtggatgagcaacagaagaacacattccaggtttggctcttcagtctcttggttttacttgatcttaagttttgagaaagataatgacaaaaagaatcagtggaagttataacttgatgaatgtatctgttcatcttggataaaataagtcgccacaatttatatttatattttaaaaatttcagttggggtgggagttttgaaccaaaaaattaaaattttgcttctaaattgatcttgatgaccagtacctcgccgttggctagaattctttactgaagcacagctgcgaacattatgataatagatgttgatcatcatgagtgtttcctttattctgtcatgaaagcttgctctttacatttcagattatgcaccggggcaatccaacagaaacattagtacggtttctcaaagcaagggatgggaatgttgtcaaagcacataaaatggttagattgtgtgcagtaaaagttttttgttggaaattttcccaaattgattgcttatagagttatcattggatatgaacactttgctgacggttttaactataacagttaattgattgtttacaatggagagtggaaaatgagattgataatgttttatcggtgagttcctttactgtgcatattattgattttggaacaacatatcttaaagcagttaagcattatgtgacagatggagatacggatgcatgttttctttctttttatattttggggggagggggatgaattcacagtatcatgtcagtgtgtcaaggaccaaactttagagataccgagataaagatgcatgttattgcaaaaagtataaaataaacctagttatcactatcactggagaatgaaatttacatggtctctgtagttatttgatcatatcacacttctagcataaactagatgtctatcatatttctcaatcattgtgaattcatgatcataaaagtctatcattgtttaaattttccttcttttttgtgttaacagaagcctataccccctgatttgtacagacgtttgcgagattctcaacttgtaggaatgtctggtttctcaaaggaggtataagttttcatctcaggcataaatttattttattttcctcctacccagctaccctcatggttcttctctgcctctaacctgtatgaatgaatgatgtgtaagagatgacatctttgtgtacgactgtataaacatagcagatgatcaacaagatgtcatctcttacataaagtaacatgcatgattgctaatttattttatttttggctgagttatgccagggcctacctgtcattgctgttggtgttgggctcagcacatttgatgaagtgtttgtaaggactacataccatctctaagccatattatccttatacattggtgctgcagtgttcagtgctgcttatctgtccattttcctttgtagcatgtgaactactttattatttttcatgatgttaaattgccagttatttttgttcaggacaaatattatgtacagtcgcacatccaaatgaacgaatatcgggatcgagtgatgttggtgagtatctagagtgtctttttttgtccctcataaattctctgacaccctgattgtttattggaatttttattgcagccaaaagctacaaagaatcatggacgatacattggcacttgtgtgaaagtcttggatatgactggtttaaaactctcggcactgagccaattgaaggtatgccagtaacttaaaaacttcttatttctctttctcttcatgtttttaatcatatgaccgttccttgattggccatttattgaagtttttctcttctcactctatctatccactagatgatctcctagttgacactttctgtttggccaccttcagcttttgacagctatatctacaatagacgacttgaactatccagaaaagacagacgcatattacatcgttaatgttccatatgtattctcagcgtgttggaaggtttgtgccagtttttatgttgaaggagttcatacggatctatcaaaatcttgacaattacagctaaactcttcaatgacaatggcaggttgtaaagcctcttttgcaagaaagaacaaggaggaaagttcacgtactgaaaggttgtggcatggaggaattactgaaggtaaacattagcatacccctcgtacagtatatcttttatgagttttccttttagttctcttgactaaattaaagtcatattgtccattgttcttgttaataattaacctgtgatatggatggagacttgaaaaagagtactaccgaattgaatttacttcattcttactagaatttgttgcaactgcgagggtttgacatacttaacaatttgaacaggtaatggactatgcatccctccctcatttttgcagaaagaaggattcgagggtgccccgacatcatgtagctggaaatagtgaaaattgtttctcctttgatcatgtcttccataaacaactctataattacatcacgcagcaagctatattcatagagtccttattaccaatcggacaggattcgttccatgtagacttgccagagccagacccagatgatgccaaaattgccaagactatagaaactgagttccacaaaattattattatagattaaataacaaaatgaaatatgactcaaaaaaacttggaggattggattatgtctgcagtgacctgcagttactttcaaactgcaggcaattctggtcctatcgagttacttgttctttgcagttgttatattcagttattggatgtaatgtaatatacgggtattacatcaagttgccacaaacttctgggtgaataacttttaatctaatttttataacccctggacgatgagcaagtaaattcgttcagtcttggaagaatgacatcaagttacagttttttctttccccgtcaattaatggtatggtatttatacaaaaatgtagaactacagtgttcagaaccgtgcctgccagacagtattatgcatggaactaagaatagaacagttggagaaaatatattttcctcatgttgtgacttatgagcactattatcctgcaacaaaaattttcctttttatatcaaatatatcaagcctaggataaaaaaaaggccatgccgttataaactacactacaacttattttctcaattatattcatgattcctccttttcttgacaaaacttagggctagcattaacctgaatatctttgcatacggtggtattttctattcattttggaaaattattcatcaatcaggtgctagatgatttcattttctgttcccaatatgggtaagagactctctgaaggtgctgcattcttttatatgaaagttcaggcaagactatcgtcatttgtcacctatgcgccacacaattctaggattaactagcaagttcgaggaacacaaaaagctttacattaaattgtaaaaggttacaaatcaaatcctacctaaacaaagtgttaaaatattaaatttgattactctgtggctttacattaaattgtaaaaggttacaaatcaaatcctacctaaacaaagtgttaaaatattaaatttgattactctgtggctaaggtttcttatatgtacaaaaataagctaactggcatattataagtgcctcagccaataatactctacaagcactaaagcgcacacatcctcactcgtttcccagcatgttcagtaaggactgatctaaagaagaactgcactaatattggacatgaagctaatatccagatatagtaaaggcttaaggcttgttttatcttggtgacttgttggtcatgggttcgaatctgaaaacagtctctttgcatatgcaaggataagactgcgtacaatatctctcccccttacctgcgcatagcgtagagcctccaggtaatggagtacgtagtttttttttttttttttttttatagtaaaggcttaagttatctaaaccacttaataatgctgccaaagttgatttctcttatctcaattgtttgtaagagttataggcaatggcaactgatacagcagcacagaaaacagcaagagctgcataagtatcttcttgctcccagccattgagccaagttgccatggacggaaacttgcacgaagctcctttgccattattgatcctattgatccaagaaatcactgtctcactgctcttattatcagctgagagctttgcctctgattcaatgacatcagggtccattcttctttccaataacacgtgattctgacggaaaaaagagtctccattagattggcagcagccaactccatttgattggcagcagctaactccatttgattggcagcagcttacagaattgtcttgagctctacacccttgagtgctgtcttctaagtttctcaagtcattcagcagaagccgctgttcttgctttttcttctgttcatctactgataaacccatctgacccctgaaggcaatataaaaaaagtaacatatacaagtaagcatatgttccatggacctactatgctccaaagttttcataaccatcagcctgatacataaccatggaaaggatttcagcatgtcaatttccgaagagggaatctgtcacccaatgcatcaaattttttccatcgcaaaaaagggggcagaaagaaatgtacttgaaaagtaatggttgaagctaggtttctgaaaatttagagaaagagtagggaataacattacaataggagttaattgtatgtggctaagtccatggtttggaatttataattttaatttgtgaataaaaagcttaaacagtcaacaaccaaactggtaggtcacagatgccatttaaaggcatatgaagcaaagctgtatatcttcagataaagggtatgaagatgccacttcttgcctgaccacaatttcaatttgaaaatttacagaagcctagctatatagtcttttataggatgaaacttaaagatgtaacctttaagccaaaacattaaagaagataaataaagcattacaggaaataattacctccataatggatctaaaatctccccctttatgatatggtgttgaagcaatgaaggtacatcatccggggtaacatagccatacctgcatattttaattgaggagaatatcaatcagttacataatcaaacatattaaccaatggtacaatggtattgcatgatttaaaacaataaataaaaatttctgtaactgaaagtagcagttttagtaaccattaaggtgttctccttaccagtggccagtgacttctccattcatgctaggtccaaatacaatgacatttccagcatactgacttgctccaatgtgtgaacatgggcttacaaagacttttccttgaagaccatgcaactctatctcctccctgaatctactgaccaagacaggtccacaaaccccacatctgcgatcacgggatccatgcgaacacacgaaaacatacgaacctctcaacacctcaggcgttccgggaagccattccccatccttcacaagaacctcctcaacaaacgtttcaacatcaaaatgcgttaatctcctgcaattccactaaaacctgttgtccacaatgatctaagaagcggaaaaaaagggaatcaataacagagaacctttaagatcaatactctcacctgtatctaaccatgtcaggaaagatcaacacatccccattagatgtctcagtcccatcatgaccctcacatatcgttaaccgaatctagtaaagagagaactcataagtccaacacaatgtaagatgaagcaacattttcaccagatattcaattaactaactctttaacacatacctcgaacagtgatatagccaaaacagcgtatataagtggacataacgcttgctaatatcaattaccttaaacagcgtacacacaaacaaaatccaaaagcaaggggcggtagagtatagtatagtacctccttttccatgtgactcttccttgcgacaacggcggcatggagcaacctcggcaagcgatcgaactcggcggcttctatgcgcggtggccagacgcgagggttcttgtagcaaaggaagacgtggcgtcggtagaactcgacggtgccggcaagggggctctgccggaaatcgggtcgggagaaaccgaagtcgggatcgtcggcggcgacgtctccggcagagagaaggccgtcgttctggaagcttccggaggcgcttctggggtcggcgaggtaactgtcgagttggtcggagacggtgatgggagaagaatgggaagaggaagaagggattgtgaatgtcagcgattcttctctctctctgttactcgccatagtagcagaacacaaccaatctctctctctctctctctctctctctctctaacaaagtaacaactttgtgtgagtgagtctgtctgtgctgtgcttctaattcaatagttcctatttcgaggggtttgatgatgttggaggaggttgcgttcctgtgaggttgcgactaggatttttcggtggaatcgggtcgtgcatcaattatgtaacacgtgtcattcatggcttctttgttttcttgatggtgccaactcacgacgatccaatctaatgcccaaaccttcggcattcctggatctactgatttcggggattctgtagagttgtctacaaattattaactgcaaccttcatgcaaagaaaagaaagaaatacaaaaattgttataagagaaagaatttataataacaggatttacaaaaatgtttattataatggattttttttaatttttggtttattagcttatgtatttgatagatagcataaaaaatttgattttttcttaagaagtattgttgtatttataattatttgaaaacaaatgttatataatttttttattctcagtataatattttttttaaaaaaattgttttatccctaactgcaattttttttttggtttaaagaattattattagattatctttcttgcgattcagtgcttttactggaggcctaatgttcttacatgttcatcttattacctaaatacaaatgtgcccatctaatagatgatattattatttattgtttggcgtgacttcgggtgagtaaataaatgggttccacctgaacccgaacccgacataatcaaacttaaaaaaatgaatttgggtggatttagacggttcatagataagcgggttttaaattcgatcccaaatgatttttgacaatcgaatttaggttcacaatttttaatatatcgatatccgacttgactcaatattaaaagtttaatttcaattttttaaccttttagctatttaatttcaattaaagagcccaatacaaaattcacattaaataacaaaaaaaaaatgataaaatatgacttgacaatatggcccaatacaaatgaataaattaagtaaaaatttgaaagaaaataaattaagtccaaagtgtcttgacccaatattggtccaacccgtttggactcaaccgtaacccgtccaacctgaaggcaaaaaacagtcagaattggacctttttgtaatttatcagatggacccgaattactggacatttgatcggtacatgacaccaatgtgttcagtcttccaaacatgcaaagaatttataatctaaatcattttcaataatcttattttaattttccttagtctttgccctattattacaaataaattatttttcacttgatattatgagggtttcgttggtcctcttcttttgtcaaattatcttattatctaatctaatgaaaaatatatattctatggtgctttaatgtaaatttgttacctgttttctaggaaaaacagcttgaagcaacatctcatttttgcctcagtaatacagtttgccaaaaagagaaatcctaaccatgcctttttattagcatttcataaagcatcaaataagcaatgtaaaaagagtaataacaattgttttattagcatttcataaagagcatcaaataattgagaagaatggacagataaaggtatggtttttttaatagttattatcatcattacagtgaatgccgtaaaatagttcatcatactacctcatgaagtagcaatatacaataatatactaaagtttcattaataaaatacttgtgaccaaactattgacaaaaatctgatcgcattggtctcaactttcacaaaaaccagtgtgtatctctcacattcatgagccgcacaaaactgtaactaggcaagagacatttcatacaggattcttcctgggaagctaagaagaagaacctccctcaacatggttccttttcctgtgaaagatgccactgatactaggcaagagaactttctttgaaactgacaccttccctttttctaacttcatctccaccttgtttggaggtgaattctgcatttgaatcctatagtgctgtggagaaagttctggggacatcagtgtttcagccaatattcgagatgcagcttctgctgctttcttctgctcttgttcgcgccactttctgagctcaccctccaccgccctctttgctgcttcagccatttcagcccttttcaacgctgcctgtgtttcagtcttcatatcctcaatttccttttgggtttcctctaacctttttagaaattcattttcactagcctttgcaacttcaacctgtgctgtggcagcagccacttttatgtctgctaatttatcagactcctcaacctttttaactaagcattcaaactcctctcttgagattgtaattcttgcaccaggttcagaagttgatgaataagaaggactagtcctcatagataaaaccttaatctgatcaagagcacttgcctctgctgctttagctgcttccacttcttccaacactactttaagctttgtttctgcatcttctaacacaagtttagtgactgcagcttccatcttcaattctgctgcctcattcttcataccttctgtttccctttttgcattttcagtttcagacaacaactgttttaatgtcaagatcatttcctctgatgcacctctagctttagattcttctgccaagtaggcttcgagtttagactcgcttttccggagctctaccctcagattctcgacaacagattcagttttggattctttctccttcaattcagagtgttctctttttgcattctccagctccatcctaagagcttccaccatgcttctaagggagtcttcctgtcctactactttctgcagtgattccttagcatcaccaagctccagagtgacacttttcaaagagtccaagtctgatgtctttttatgttcaatttgcttttgcagaaccacaatttcagtcattgtctcggtcagctgcacttcaagatttttggtaagctctggattgaattccttctttaaatcaagcaacttcttttttgattcttcaagggtggcttcatatgattgtcttggaactttttgcttggctaatgtctcttcttgaagttgatgtgcttggacagattcagcattcattttctcaactgattcctgtacagccaaaatttctttagatagctcacatgctttttcggtgtttgccttcattgcatcttcagcttctgctgcttgcttgagagcagaaactcttgctttcaaggataaatcatacccctgacgaattttactcagttcttgcttttcaacatcaagttctgtaatgacagaagcataattattaagggcagtttctaactcttctttccaagcaccattggttccaccaggatcaccacatttttcttcaagctgttttgctttattttttgaagcttctgttgcctgaattgctgattctctggattcaccgagaactttaagcttttgtgagagatcctcaaccactcttttagccttttcaagctccaccaggacttgagccttggtagtttctgcattctttagttgttcctttaattttttcaggtctttctgggctaagtgaagttgtctcacctttgcccaaacactctaatgaaataacaaaccatagaaacaattttcacttatgtggtaaatgagagcatgtcattcatgaatatgatacatgttaacaaggacatgtcattggcaactgaattaaagcatgatactggattgtgttgaacaattgtcaaattttgaagtccaaattataacaatatagaagattttgaactaataagaataaaagtttccaatttttttcacatttcaccccactcaaaactttttccatcagaacacgtggtgcaaacacaaatttagattcatagtaacctctacaccaattctaggaatgagttttacactaaaactattggtccattataattttgtctttttgatatgcaacttcagaattcagatatagttttaaaattacggtataaaaacagttacctcagcaaaatacgattttgccttcttaatgggagcattgggaggtgtttcaccagagaaagcaccttcgccaaatagagaaacagcatctttaacagattgaaaaggtggactggtgtcaatctctccaaccactggttttgtgggatttggagagttagcagcactttgcctgattttggctaccatattgtcttttatttaaataatattaacggcctttgaagccaacctgcaaaaaaaaaaaaatgttacagtatgaatatgatcaacacaacacattgtaaacatcaaactcaatacaatcacacatatcagagattcttttcaaatccacacaaaaagcaaccaccaagtagcctattcagacattttaacaaaaccccatcaacaaaaccacatcaaagtttccatctttagctgaatccacaagaaaaatcacctacaaatatcaaaaagagtaggaaaaaaaaaactttcaaagaggtgcttcttgaaaattttcatgagaagggaaagtgtgacattgaattgcagagtgaaatcgcgacgaagaatgttcacataattgtgaggagggaaagaaagaaagagagagagagagagagagagagagagagagagagagagatgagtttggttgaagtgaaaattgcgaaaaggtgcggtgtgtttaaagacaaattttgcatcagcatgtcagtttcagactcaagagtttaaaagggaataatcatgtgcaacttgttcctattcaagattcctctaattcagttataatggttttaagatcatatatgttatccgtagcactatgcaattgtgacttgtgaaaattctgtcagaataaaagttgcagtaaagatggttcgccacgtcaccaccaccctcccttcacaatgaacaaaggaaattttttatttaatttatttaaaaaaaaatgagagtgacggtgatgtaaatcagcaagaaggcaaaggacaagctctcttgtcctttttcaacaatgtgtctcgaacatgaacatttgctagcaattatttgggacactcatgcttcatgcttcatacttcggttgcccatatacatcctcttcaacggtgatatcgagtagtagtaattcaaatctaatgcataaatatgtattatacctatacgggtaataaataattttcctctaaaaaaggggtaataaataatttatcgcatcgtgatttgattgtatagaaccgaggcacggatttgcacagggttactatttttattttttaagtttgttatctgatttaattaattataaaccacccgggttgatctagtgatagaaagtttagaataattttcatgatatcctaagttcaaatatcagtgagatctttgtagattaatttaattaattacggattgagattgtttggcatcggattccacttacaaaatttgagacatgaaaaaaagttacacttatatgaagtttctaattctctggttcattattgttcataggagaatgatttgttaatgtattggggccgaaacctcagaaaataacatggcaggtatatataagtcgccttctattgtctgaatggtgggacttggataagtctgcttgacctacaaatggattggagtgggcattgggcagctactaagtatttaaaggcccattatacttaatgcttttgctttcaaatccttttgttatggttattttctacttccacacctacatttcactatcaagtgaggaggatatgcccaaaatttgtactagtctatatagaaacgtgtataaatcacgatagttttagttggctttattatctttttacggtctatttaaaagaaagaaatcattatttaaattattttaagataattatattaaaagccaacaaatttatcatatattataaattatgatgagatgattgtgtaaatttttttacagggtataatcttttttcttaacaaaatacattttaaaaacttttgaagattttggaccatgaaaaaagttaattattttaaaaaataaatatttgagtagcttttttaaaaaatatattttttaaataatttccaatttattttaaaaaactgaaaactaaaaacaattttaagttatttctatttttactctttagcaaaatacaaattttacaaaaagataattataggtatttttgcatacacatccatagactaatattcaaatatttgtctttatgtacgtacctctgtttaatttgatatcgagaaaaaaaaaaaaaagagtttggagaaagggataaatagaattttcttcattaatttaaatgagagaaaaaaggataaaaggatacaaaagagaaatattcattttttttcctttaaagagaagtgaaaaccaaggagggaaaatggaatcattgtttgcatgagagtaaggcagtgatataattaaagggttgaagttgaggtgaggcagatatactgtcgaaataccgtgatagtatctgctgcatgatcattataattgtcaactcaatcaagtaagctacgctgtcgcgcgctcgctgcatagatcatgattaatagctgcatgcccatcattatcaatatttctctattaattgattagggtatgttaccagtaaacgagtgagtaattaatgatgattcattgtaaatgatcagtgtcgttaatgcaaccaagacgattcttcaataaataaaaaaataaaaaaatagctaagtattacattaatttccaactgggttaacattaagcatatatgaaactacaagataatactatctccacctctgtgatttacttctcctttctaccaatctgctccataagcaagagaatcatctctcttgtaattaattaaatttcccacactagctctaagttaattgaagtctgattaacgggttttgagattgatcttaaatcccatatataccctcaagaattcatcatagctgctagttaactagatatttgtatcatgcagactccatattattgtggactttatatagagagagatctgaaatgtcatattgggagtaaatgaaaagcatatccagtagtacaggtaactgaaattgttgtaagatcaaataataggcataggtagtgttgcagtatatattcatatatactactgaaactagtacccagcagggaattatgtttccacttaaaaagagctagtaattaaccacacagggaaccaaatctgacagaaggatgtcataaacaaatatcagttttgtggtgcgttttataagaatgcatgttaaatagttagtgaaactttcgagtcaacttgtggattccaacactttacatttcttggattactaattgggctttcgaattaaatttgatacatctctcatgttttatacaattatcttctttactgaatgaaacccaaaataacttagtctgatatatacagagcagatggcaagaaaaaagaagaaaaaaatggagaatgactagctaggaaaaacaattgcgattgtcattgtacatgccacaaaaacataagacaactcagttcttaataaagcatccaatcaaattaaaacatccaacatagctacaaatgggatggaagttgctggacattcaaaatgcacaacagaaaaaagaagcctaaattttcatgacgaaaattcgtagtttttcttaatcgaattcaggtgacatatttcattttttttttttaattttctattttatgataaggctccaatgaatcagactttatcatcattagtattatcatattactaaagttatatttttattattattttcacctataacttacgtacattaaaaaggctatagcttatcataaagatttatttttctcactcataatgtcttagtattattatgacttattattttgatgtaattaattattttattctagttgaatgtcttcttaaggctcaacctttgggattttttgttttgtttttggtacattcaacctttgggctttaaaagaatattatcttagtgttaagtctttagtactacgatgttactgttggtcccaataaaattactcctagtccctatcagtcaaagacaattatcaaactacccttctccacctcaccccaccccaccccacccttcccaaccccaccttgcactcatgctgccatgcttcttttttttttttttttttcgtggtcaaacgtaattatactttcgttgtgaaattttgcacaacgaaatcacaattttgttatttttggtgttgttggtgcacgacgaaatcattattccctttggggctttaaaagaatactaccttagtgtcaagtctttagttatagggtgttattattggcccaaccaaaattgctattggacccaacaaaatttctcttggcccctatcaaccaaagacaattaacaaactacccttccccacctcaccccaccccacacttcccaacccctccttgcactcacgctgccaagtatttttttttttgtggtaaaacgaaattatacttccattgcaaaatttcgcacaacgaaatcacaaattccttatttccgtagttgttgatgcacgacgaagccatgattccgttgtgcaacaacaatccgttgcacaaaggaatcatgattttgctatatgaaatttcacactttcattgtacattttttctctccgaaagaatactaaacgaaagtgtgacttcgttgtacaatggaatcacactttcgtaatactgtcatgttttaaccttccttgcacaacgaatcatgattttgttgtgtatttttttcctccctgaaaaatattacgacatcatatttttgttgcacaaaaggaagcgtaaattctatgcgcaatagaatcataattttgttgtgcataaaattcacacccccttttgtgcagcaaaaacacgataccataatactttttggagaagagtaatcttggaattttgatgaattataggaatcaatcgcaactaccttagttattagtatttcaactaaaactcatttggaaatgatcctcctcaatgcatgtgtgtaagagggaaatggacatgtaaagagaaagaagaaaaaaaagaaattgagtccatacactaagctgtatttgtttaaacgttgagttcaattgaatgagaaataatatttttggataaatagtcattttcgtccctaaacgtgtaaagtcttgacaaatttgtccccgaaagatgaaaattcaaattttaatccccgaaaatgaaaaaagtgcgacaaatctatccatccgttaacttctgttcgttaccgttaatgaaagagcctacgtgacgcatttagagacgaatttgtctattgctctgaaatttctaatatgacagtaccgtacccaaaatatgagactcaaataaaaatgtatagccattaagttaatccttacaaaaaatgagactcaacttgattttgtcactgcctaatgttgtcacaataaaaattttaaagtaacagaaaaattatgtttattaatcaatgttatgcttattattatgtttgttttcctattttttaagtgtttattgtaatattatgtttgcaacgattaataaagggagaaagatgaagattaaattgtattttggataaatagtcatttttgtccctgaatatgtagaatgttgataaattcgttactgaatgtgtcaattatgtctttcattaacaataacaaatgaaagttaacatgtagatgaatttgtcgcacttttttcatttttgaggactagaatttgaatatggataaatagttatttttgtccctgaatgtatagagcatcgataatgaaagactacaacttccttccccgtaccaagaggctagagcatactggcacgttcgatcccttccttgcattccaactgaaacattctatcagctaggaagttaagttatttttttgacaagatatttaaattagtttttaatttttttattaattaaaaaacatgttcaataaacaaattttcttaatagtttctaatgttttttgaaatattatttaaagtaacattttttaaaatattactttctagtttttatattttctttcatttttatcctcattagatttatctaattttttaattaccctttttaaaataaatcatgattttattatttttcatcattttatacttttcaactactttagcaattaatttatcaaatacttataatttaataaattaattttttaattaacaactaatttttcaattttcaattaacttttcaaaataattttacctaacataaccataatcaatccaaaatttcaaggcaatatttttttttaacacagtgccaatatattgcatagaaatacaaaactggggggtgcaagattaatgaggataaaagagaaatgagagcatggttgaaattgaagcatgcaaatgcaatgcaaggaatgagacaagaagaaaaaacaagatcccctccctcttacatgcacttgctaaaacaaaacaaaaatgccagacaactgaagggttacatcgcttgtacacaaagcctcacgcatttttaaaaattttttatttataaaaataacaaataaatttgttgaaaatatcatttattcattaatcattagcaaaaaaatatttttcatataactttttttcattcccatccaaacaagcggagagaaatttctttactattttctttcttatttatctattcaaacaacacaatttactcctaaactaaacaaagtataagtgagaggaggggagtaagtggtaaattcattctgctacacgctattattgtatatttgtattaatataaaagtttatatacaaataaaaaatataaaagattatattgtgtcttgcaccagatgaaaaatttaataataaataattaaatagtaataatagtctataattaattcccaagtataagttttagatatcaaatctaaccaaattttctatatctggttcttattgaatttaattgtcatacacgatgaatgtatatatataacaaatttatattgttatctaataaaaaattatgattgcatgacgtttaatataattattatgagaattaataaatttatcatatataactcatattaaaagacaatgtaaacttacatcgtcaacatagttttttttatcttttttatttcagtaagtttttgaattgttcatactattgacttgaccaatttccaatttaaaacgatacatgtgaagtgagtccgtttttcatagaaaaaggttacattcacaaacatatacaatagataaaatgacattttctgtatgttttttctcttcattttcttgatttacggaagattcaaagcactatgaatgaatgaccaaatcataatctgcgactgttattgactttatatattcaaaatacaaattggtacgtagtttaaaatcgacccatatgtcaatttgatccctctatatatagagagaaagagacattataaattaatattagcaattaaacttgtatatatacttatattatgcttataataattttttgtagaatacaaaattaactaatataataattgaatcattggatattatcattttgatcatctatgttacatttcacatatattatatattttttagtgttttatctagtaagtagatatttacttatattttataacagataacacgtgaaaataaaatagtgtgataaaataatattaactacattttatttagatttacttgaaattttataaactggtttaaaatatatatcggttagttatcaaaaatattttcttagaaaatagagtactacttaatgtgagtacatatgtgtagtattatttgaatatatgtatcacacatgagtgttgtcttttttatttaatttggtaatcactgtaattagagacttaaactctccaataatacctaagatatttttataaatttcagttctttaaaccaattataaaaataagttttgataagacttaatcatatttaaaattacattcatgctgacatagtggtaataggcatatcttaacgcatgtaccaatgtgtgataaataaaaaacactattcttagtaaaaaataattctagtagtattacaaccaatcaattaaagacactattaacgataagttgaatttaaagaattatttatgaaagtttatatattaaatcttaataagtacactcccgtagtaatactttcgaaaattctccaccacgttttgtccattttgtggaaacatattttattgaaattttattaaaaataatatctggcctgtataagatgataagaatacgtgaagaatattaatttcttatgaacaattatatttggaaaccttgctattgagttccatagaacaattttgagttcgagttctaatttacatttgggttattaaatgtgcagaggaaaactttaatcaccgaatggtcatatatattctaataaaacctctactatttctttatcttgctaaatgtcaaataacatataacaagttattaattacaaactcgtaagttgacataataatctaaaattacaaactcccataattattttgaccatgttttgtcattttgcggaatcatgtttgattttattttttgttaaacataatatctgcccagtgacaagtataagatgataagaatacgtgagcaccgatattttgagtaaatgattatttttatttttatatgtataaagtgttaataaatttatttttgatagataaaaatttaaattttagtcttgaaagtaaaaaatgtgataaatttatctattcgtcaatcattattaatgaaagaatctatgtgatacatagagacaaaaatgattaccaacatgattgctaaatagattggatcaaaatgtgaggaagtttttattggattaatttgttagatctcaaatttcgtttcatttaaaggtaaaatataatttaatcttcatctttcttcatatttttttttatcattgcaagcacaacattataataaatattttaaaaaataagaaaacaaatataaattagaacaaatataattataagcataatatatattgattaattagcagaatttgtcttttgatttgaaatttctattatgatagtattaggtagtgaaaaaaattaagttatgtctcatttttttataagaattaacttaatgattgtataattttgtttgaatttcatattttggataaatatattatcacattagaaattttagagcaacaaacgtctaatttatgtttgtttttctatttttaaatatttattgtaatattatgatttcaacgataaaaaatgggaaagataaatattaaattatatttttacccttaaatgaaacaaaatttgggttcgatgaattagtccaatgaaaacttataacattttggttcaatttatttagcaatcatgttaacaattattttgtgacatttttgtctttatgtgtcagataagctctttcattaacattaattaacgaaaattaacatattaatgaatttgtcatactttttttttactttcaaactaaaatttaaattttcatctttcaaaaaataaatttatcgatattaagaaaaagactatttacgatgatatttttattattcggtccgcgatgtgaataaataacattaatagtccataccatatgtaattgtccatctccctttccacacagcacaaacacagaatctcgtgagaaagaagctgggagacagaatgagagaggaagaaggtgcgagacaacaagagtccgatgttgatgttagtttgttcgagacaaaagaagcaagattccgaggagtttacaaggtatttgcatcaacaatatttgcagctatatgttttatttgggtgtacagagtggcaaacatccccacagttaaaagtgggaagtgggcttggattagtgttatggtgtcagagttgtgttttggattgtactggatcatcactcaatctgttcgttggagaatccttcaccaaacgcctttcaaacacaggctctcacaaaggttactttttcttcatcctctccttttactttttcatttttttcatgtccaggggaaaatattaaacatacacatacgtatagtgcttttttgcttacattatttatctcatttattgatttctctcacttgcttcatttccactcgtacaccttaaaattggacgaataaaaaaaaattatattctgtgagcaatatttataaagttaaaataacttggactgttggtgtaaaaaaatttacactgttaattatgataaatttttgttaatataattattaagataatttttataaagttaataaatttatcatttatatatatatatatatctatggtgaaaatatttatattatacattgaattatatattacatttcacatcatgagaagcatttgtatatttacacatgtgtatggagtacattaaaagaaaaaaattaaagatttgtggggacaattacccccaaagtataccaagtatatctgtcctgacatgtgcaagtatagaaggtggaatagtgtagggaaaatgaagcatagaaaaaaatgaaaatcgtgataactactataataagaagtatataaaataagttagaatatatatatatatatatatatatatatatatatatatattatcctttgagaatgacgatcaaactgaatccttgcaagatgcactcaccacactgtggtgacttcaatgattgtttttctccctctctctcaataatattgtttctaagagttcattcaatgtagtgaaaagaaatgaaataaaaagaaattgataaaaaaatttaaattaaaataatacaaaaatataggtctcgtattttttttctcactttgtatatttctctacgtacaaatgaacgaacctaaatgtctttcattcttaactagaactagaagtatttcattttcaactatataagtctattttcttaatttgatattcatttaacaaaaaaagtgaaaggaacatggaccgctgaattaaatatactcattagctaaatcacattaagagccactgcaaaaaaggctaatggaatcacgctcaatactactactttacactctttcgacttttcaaataaatcccatcaatagccagtaagaaacaagcgaaaagtctaacggagtagtatcgtaaaccaattaccaaataaattaaagacctaaagactaaacattgcattgccagtcaactttttatactgtttcattccctccagtggtcctatattccatttcacaaatattttgtgaacataaatataattaagtataatattaattttgtacgttggaataatgtgattctttccggaatccatatctgcggcttctatttatttatattttatacataagaaaattatattattcgagtatagtgtgaccgaaaataaattgacggatgatgacttatcctagttaggtttcagcttttgcatcatttttggctgtatataggatgtgtgcatcgccgactgtactaagtaactttgtaattagttctggtcagggtgtaagcggattgggtggcaaatccgtaaaattcaatttaatctattttttattattattttaaattaaattattggattgcatttattttatttcagtaaatctaattaaaattaaatttgatagtaagttttgaattttagattcaatcatagatcaatctaactcatatgtaattaaattactaatataaaaattttaaattgaacatattttattatttattttaagataatacactattttataaatagtagtttgatcatacatttttttcttgtttattgtatcaatagtataatatttttaataatgatttctaaagatatctttactattttattaaaaaaaacattcttactatttttgggttttgagaatttttttaaatatgacaatttttttatgatctaattcgataattaacctaatccaattaaattaaagttgaattgagttgaaaaaaagaagataaatccaatttaatcaaatccaattgagtttgattggattgaattgaaaaattgattttttatcaatttaacataggtcacttccagtactcttagttgtaggattaaacatgtttttggtttttctttataaaattttaaattataactttggtttttataaaattttaatttattttttgctagtctcttctctatttaattttataaacattttcagtttttgttgataaatgagaagtgtgtttcgtgtcagtatgtttaatagttatatatcactatatagacaccttgcgtgatctagtagtcatgtgatgttcatatctatctattaacagattgtatgatacgaaatcacatggcaattaatgtgatgacgtacggcgcatacaacttattaatttaatctattcttatttgactaattttagtcattttaaatatataatctattcttcagttattttcacattcaactaactaaatcattatataattttttattcttttttataagacattttgaacataatcatatataatcattaacttattatgaataatattaaaatttaagaataatacatattactattaataaaaaaatattaatacttagaatatttaaataaaagtaactagtattagaaaaaaagtattgcttagaaattataaatatcttataaaaaatcatcaattctcctaaatgatgtgttataataaggaatatagaaaatatgtcacatcatagtatcatccataccattattgaaattagtggtgaaggtggaaatgtcaaaatctctattgcattctctctaacgccctatagactatagtaactaatagagttccaatacttcgaactctgattaaacaaccttcacaaactttggaaataaagtcttggagatatatatatatatatatatatatatatatatatatatatatatatggatttctttgttataattaatgagtttcaaacttgatatttttctttaattattacatgatgcatgtcagttatatataataaggcaaagttaagtagagttgttccagacttgaattagagctcaatgtatgttggatatttgagtgtgtgtcttattaaattttattttttcaagtaattgttatacgtaaaatagtaaaaatatgatgaatattttttggcatgtctttacagatatgacgaggagaatttaccagcagtggacatttttgtgtgcacggctgaccccatacttgagcctccatgtatgacgattaacacggtattatcagcaatggcatacaattatcctgcgaataaattgagtgtgtatctctctgacgatggaggctcagagctaacattttatgctctcttaaaggcttccattttctccaaacattggttacctttctgtagaagattcaatgttgaacctaggtcaccagaggttttcttcgctgccccaacttgtagcaataataccactgagtatgtccaagcatggttatttatcaaggtaactgactttttttttttttacgttgaattatcgatggttatatatgtccatatagtgctgtcttcaaatgttactaatattgttcgggcacggtgtgcttgtgatcacatgaaaattcttggagttgaacaattgatgtttttaattcaaaggtttgttatacggaaaggaatgcattagaaaaaaaaacaagtattaaataaattaatgaatgtatatttaacatttgaaaggtaacaattagttaactaattagtgcaggtaatagatatatagatacaatgagctgagcgcatagatcaattgaaataagttattttagtttaatcagatgtcttaaatttgtattttatatgggatctataaaaaaatatatatctaattctcttaaataaaatgttaaatttgagttttatatatgaattcaaaatttcaaaattaggttactgaatatttttaactcaaataagattgtctcatatgtgaaaaatatatatacaatattaacaaaaaaaagtaatttttattaataaatattaattattaatttttgttagtgaaaaaattcaaattcaaattcaatacaaatacgttacttgttatttgtttgttttctatataatcagtttttaaaataaaaagttaaatacatatcttattgttttttctttaatttgttttgcctgattctgtaaatgttactcatttatacgaattaagacataaaaagtgagatttcattctttgatgaaaaatttccccattttccatttcatatatgtcagaaattatacgaagacatgaaaaatgagattgaatcagctgtagcaaggggcaaggttccagataatgtgaggaatcagcacaaaggattctcagaatggaatccaaaaacaacaaaacaggatcaccaacctatcgtgagggtatggacatttttaattttcacaaaagaataagaattcacgttggaattaatctactatcttagttttctatataactaatttttcaatataatctttattcttcattttattagataataattgacggaagagacacaaatgctgtagatgaagacagatttcaactgccaagagtcgtatacatggcacgcgaaaaaagacccaactaccctcaccacttcaaagctggagctgttaatgcactggtgagtaatactcacagcaatacattaacagtgtatgctaattaaactcataaatttatattttacttgtaaaaatgtatttcgttttaatttaaaagaattaaatcttaccttacaatttacaaatgcaagctaacaatatttataaaaaaaagttaattaactctttatctaatatatttttttcacttaaagtgtcttaatactttaattagatattaccctaagctttgcagttaagctaaggttttttttttttttttttttgaaatagttaggctaaagataagaaccttgaaaattaaaccctttttaagtttttttattattatatcttagtatactatgttttccactcactttataaacttgtcttttgtacattgatgatgatattttcaaattgttcattcaaagacgtatttgactatgtttttccaataacaacaaacaaaaaagaaggaaaattctctattattatttggtgttagtgtcacatgtcaaaagtttcattctgcagataagagtgtcatccgagataagcaacgcccctttcattctcaacttggattgtgatatgtactccaataatgcaaatacaattcaagaaatactatgcttcttcttggatgaaacaaaaggccacgatatagcttatgtgcaatttccacagagctataataacatcaccaagaatgaccattatgcaaattcttatcttgtgagcagtaaggtaaataataaaataatgtaattactttatagtttatacagtatacatatatataaactcacacataaggatggaccaacagtatattgagtctgattttcttaatatgtgcatataaagtttgagctagctggcatatgtggatatggagcagccttattttgtggaactgggtgtttacatcgaagagaaagtctatcaggagcttacttgatagattacaaagcaaaacgggacctgaagcctaaaagaaatgataatagaacaattgatgaattgaatgaagcatcgaaggctcttgccacttgcacctatgaggagggaactcaatgggggaaagaggtttgcgctcatgtgtagattttaatttatctcagaaatttcaatatttaataatatatatgaatcttgcagaagggattagtatatggtattcccgtggaagacatagctactggccttgtaatctcatgcaggggttggaaatcgatttattacaacccagaaaggaaggcttttgtgggcatagctccaacaaccttggatgtagcatgtcttcaacatatgaggtggtcagaaggcatgttccaagttttcttctccaagtattgccctttcatttatgggcatgggaagatacactttggtgtacaaatgggatattgcaattaccttttatgggcccctatgtctctgcctactctctgttatgtctttgtttctcctatttgcctacttcatggcattccactgttcccacaggttatctcatgcgtttaattagcttgatttgattgcttaattttcttgcacttatttacctctaattcgtgtttttgcagctttcaagcatatgggtccttccatttgcatatgcatttcttgctacatatggctttagcttgtgtgagtatttgatttgtgggtccacggcaaagggttggtggaacttgcaaagaattaaattcatccataggaccacctcgtatctctttggtttcattgacaccatgaaaaagcaattaggactgtcacagacaaaatttgtcatcacggataaagtggttactaaggatgtccaaaagaggtatgagcaagaggtcattgaatttggaggctcttcaatcatgttaaccatattagctacagtggcattgctaaatctttttggtctcgtttggggaatgaagaggattatgatggatttggaattcagctctagccaattgatgatgcagattacactgagttcattggtcgtaatgatcagtttaccagtgtatgaggcacttttcattcgtagtgataaaggttgcataccatcttcagttatgctcaagtccattgtcttggcttcattagcctgttgcctagcacctttcatttgctaatctagttaaatgtcaaagtacaatactgaaagtgtggttcatacttactagtgataagaatctttcttagttcctagtttggcttcattgacttgaagcttcaagtatgtgcgctaattatctttattagagtactttggtttcatgtatctaaacatacatctagccactattatttgttcatggaaaccggacattgagattcccaatatttgatttacaagaaatactagcaatgcacatttcaatattatatatttgacatactcccttctgttagggaaattcatgagacccacgaattatgtatgtctgcttcttcgtacaatagatattgttttcaaattggtatgattttaggaatttcaactaataaaaaaaatgagtcgaaaaaaggtgttagataatatatatttgggttaattagacatacacttctttatatatttttatactaatatgtttaatttctacattttaagatttacctaattaaatttaacgtccaggcactatatatttggtaataacaattattttttgttacataactatttgtttcattttgttcgtaaaattaatatttaaattattaaatatacttaaaacatgttctaaactaattataataataagttttatattaaacatacggactttttgacgaaaatgagaattttggagaaaggaaatatgcaaacggattcttttaagaagtattttcatgtttcagacattcattcattttccaagtcttagcaaaaaaagtaatttctgcatgtcaattgtatgtaattagaatatatatatatatatatatatattattgaagttatatttataattatgtaaaaagtaatttttatatcgattacaaatataaccgatgaaacatcttttacatcaattatatatataatttatgtaaaaagtaaaaaatgctaatatttgaagacatgatactagcggataagtagtgtctaaaacaaccctattatcattgtaaatacttctaaaaacaatccctttccatatttacttttgtcaaaatctcattctcgttaaaaagtcaaacatatatcactgatgaaatagagaaattcttgcttattctatgagtaaggtatttttcttgttctgtaccatttattatataacatgtaaataatatggatcattattgtcttctatattaatgagtctttttaattcttctaaaatattaaccatagttaattttaatttttctaaataactacactaaagcaaaaattttctcttgaaggtgttatgggtgttgatataaaattcataaaattaaatatattttaaaaaatttatttaaaaaagagaaattgatatattttaaaaaaatcatccaaacaaataaaaaaaattggttgcattttttatttttttagtagtttttgatttttactttagataggtttacatttaaacaccccaaaaaaataagaaaaaacaaaagtataataaagatatttttgtaaccaactcataactatttagtttcaatcatgaatataatattacattgtattatgatgagagaaaaaattacagtataaatctgctattaataatgaacacgtatttattggaaaaggtaaaaggttgcaaaaattatttggggactagtgacgcataatcataagttttatattggaaaattttaatcttccatttaaatatgacgttaaacaagttataaataatgaatttgataaaatttaaatactaatttttgtcaagttaaagttttctatcatcataatacaaagtaagatcatattcatgattgaaactaaatagttatgagttggttacaaaaatatcttttaagttattatacttttattttttcttatttttttggggtgtttaaatgtaaacctatccaaagtaaaaatcaaaaactgctaaaaaaaataaaaatgcaaccaatttttttatttgtttggatgatttttttaaaaatattaatttctcttttttaaataaattttttagaatatatattaattttatgaattttatatcaacaccttcaggaaaattcttgttttagtgtagttatttgaaaaaattaaaattaattatgattaatattttaaaagaattaaaaagactcattaatatagaagataataataacccacattgtttacatattacatagtaaatagtacagagcaagaaaaatatcttggtcatgaaggaagcaagaatttctcaatatgaaataattaattttgatagtaagcggtgggtacaaaatagtaaagatttaaatatattttaaatttataaatagagtttggcggttagctttgtttttagcattcttttttgtttcttggcaatatatatatatatatatcgtggctatatgtgctgtcaatgggttagtcagtacatttgtgatcacccttttagcttagcttggagtgttgtactgtcaatgcaacacccatcacacaatataagaaatatcaatgaataacatattgctccattgcaaaaaatttaaatataagaaaaaaaattaaccgactgcaagtgcaacaagaacactggatagaaaacttgaaggtaatggagagtggtgaagactattcactgtttgagactaggaaagacaaaggaaggcacattcgaaggatctatgcaatctctttgtttgtggccatatgcttcatctgggctttcaggttgagccacatacccgcatatggcaaatgggcttggcttggtttgtttgctgcagagctctggtccggcttctattggctctttggtcaagccctccgctggaacatgctgttcagaaaaaccttcatcaatagactctatgaaaggttcaagttcgatctacacctttaatttgttcccgtgtttaagaaaacatttttttgattttttttttaaaattattaaaattgtttttttttaatttgttacaaatatttgtgtatgttttaatatctagaaaaattagaaattacaagtaattatatattactacccaatccaattacttaggattggagtatttataaatcaaattttaacctgttaacctaaacaatcacttaaattcagttggttgagcattatatatgatgaattattgtaaatttcctctataatgtgtgtgttttaatttgtgatagatatgagagtagcttgccgagagtggacatttttgtcttcacggcagacccaatcattgagccacccatgatggtgattaatacagtgttatctgtgatggcttatgactatccagcagagaagctgagtgtgtatctctcggatgatgcaggctcagacataactttttatgctcttttagaggcttctacctttgccaagcattggatgccattctgcaagagatttaaggtggaaccgaggtcacctgctgcttattttaacacccttgtctcaacaaattcacacgaccataaccatgccaaagacttagatgccatcaaggtgcggagtaatcactttttttttttttttttttttgttcatgtcacttgttgccaatggaaatccctaaatttgatctaaatcttgctattgttatgtacataaggtttgactaaattaatcaagccttttatacaaattaactaattatttaaaatttcaaattgtttggaggtggttgaccttggtttttatttataatgatacccttgttaattagacatatataattttggttataaatgacaatctcattaattcacaacttttttgtaattaagttccatttaagtatctaagttgcatttttttttagaataaaaagttgtataacaagaatatgtcatgagataaattttaaaaaattaaataaattggtttgcatactctaattattttgtgaaggttgcctattttcttctcacaacagtgtgcttttattttgtggtagaaactatacgaagatatgaaaagacgaatagaagatgtagtcaagttgggtggagtacccagcgaagcaagatcaaagcataatgggttttctcaatgggattcgtattcttctcgacatgatcacgatacaatccttcaggtgaattatactttctcaacattttctataagtatatatttgagagaattatatatcgacatgtgtataaaattgttaaacaacttttgttaaaaagatattgtcgttctttacacaagaatgtaagttgtcgtgactcacaggaaaaaaaaaatctgcacagtaactcttagcatacttagctttatttagttaagtttgggagaagttaattagctatataagttagttaaaacttatttgaatacaagactagaagtgtttatgagagtttttctattggaaacctaagtgtccaacttatagcctcattgtatataagcttgtaataactcttctgtaactaacaaatcataatacaattgatcattcaccacttactctcaatttctggtttcttcttcctcaagttattgcttcttcactcttcactttcagttgaacttcatgagtaacaaaactactcgtaaaaggaattacacagaattatattaagaacatatttttcaattaatctatgcaccacattgtttttcaaatttataccatatgaagttcacatttttgtcaataattttgaactcaattcggctcatgagttttgtgttgtcctatatataagtttgatgcatggtttgctcttgtggcttgattttcttaccagatactacttcatgaaaggaactcgcacaattcgaaggatgtagatgggtttgttttgccaactctggtgtatatggctcgtgagaagagacctcaatatcatcacaactacaaagctggagctataaattcattggtagtgtatataattaaaacccgcctctattttttatttaaagaatttaggatgaagaatagtacctcaattcatgttagaaaaatctttcaacttaaaaagtatttataaggaacttaattacatttacttcacctaaaaaattgatcgaatagaagtttaagcctactactgggtatatgtaaaactgtcttaatctactcaatgaatctcttgtggttaaaacatatacagtttcatacgacttaaaaatagcaaacaagtaacatggtgcttattatttattatttacaaaaggaggttcacaaaaaaaataccactgtatatatgagccgtaagtggttgaatcattcttgcgatcttttgcgttatagattatagattatttacattggcacacatcgtcaacgatctaattaatcacccatgtgcatgagtgtgtctatatatgctgcctaattatgtgtgtgagtaactttttatggatcatttgtcaatccatgtggattaaagataacattcttttcattgacctaaatgtagctaagagtctcttcaacgattagcaacgcgaaaatcattctaattatagattgtgacatgtactcaaaccattcacaatcagtgagagatgctctttgttttttcatggacgaagagaaaggccaagaaattgcttttgtgcagtttccacaaaattttgagaacctcagtaagaatgatttgtacgggaatgctatatcagcaattgtggaggtgagttagataatattgatggaatggaatactgtttttccagaaagattaaattcttccatttgcattacccctgtttctatttgatttcatttgtagatagactttggagtataactattatatatatttgtctatttgttttatagatagacttttgagtataactattatatatatatatatatatatatatatatatatatatttcaatttgaaatgtacataattttagtgaaaagaatatatctgttgtgatttctttaatttagacataactaatagctattaataatgtccactaattatttaaatgcttaaatatggttttatttctaataaatatcgattttttgtgtttatttctcaataaatttttgttttacattgagtgtttgataaaataaaatttttaccttttgtcccttacacttattttagtatgataaattagcaaattttatatttgttacctaataatttttatttatttattattagttgagactaaaacgaaatttgttaatttattagggaacaaatataatttttttttaaaattctttaatttaccatagacgaggacaaaaaacaagtgttatttttattagaaattcaacataaaacaaatatttattagaaaacaaacacaaaaataagatatttattaaaaataaaaaacatatttaagtcttatttaaaaataataatttcacatttatcacgaccactatgaaggtggagctccatggtgcggatggttatggtggccctttgtttattggaacttgttgctttcatagaagagacgctctatgtgggaagaagttcaattgtcaatacaaaaatgattgggatgatgagaatgagaaagaggtgattaaagcaaacttgcatgaactagaagtggaatcgaaggcactagcaagctgctcctatgaggaaaatactctatggggaaaagaggttgtttactttgatctttctctctctgttttcaaaatcacaaacacccccaaaagccaataataatattaatagatgagtatatatacattaaagtacaataatgaataatttgaagtgtgtataacttatttctttgtagattggtgcaatatatggatgtcttgtggaggacgtgataacagggttgtggatacattcacaaggatggaaatcaatatattacaacccagcaaggagggctttttttggaatagctccaactaacttgcttcacacactagttcaacagaagagatggggtgaaggcgacttccaaattttgttttctaagtacagtcctacatgctatggtgatggaaagatcaatttaggcctattaatgggatattggcactttaactatttggcaaccacttgtttgccaatactatattactccatcatcccttcactttatctccttaaaggcattcccttgtttccaaaggtaataatgacctccctttttctaagagaatatataagagatttgcaacattttattctctcccaaactccttatcaaatataaatatacattataaattactctaaatttatattattttggagttgtcaatagatatgattctataaattattttttttacatctttcagaatttcatagaattttttttattaaccatttgatttcaaaattgtttttttattccaataaaaaaataatagaaaaataaaatttaacgttaaaccaaatctcaattattttatttactctaaatttaatttaatgttctttttctattattttattttactcattgttaaaccaaatcttatgttaaaaaaaacatttttttgccacttaaattgataagaattagtggcctattagaggccgtttcatttaatcgagttttaaaaggccttagttttttttttctgaaatttttctttgcttgagtcttttttttttaattatatttttttcccgtcaatttctctattttgttcaaagtacaaatttttcctttgatatggactttcatatcttattatcatttttctatcgtcaaatgttaatttagttaaaaatatgtcggcagagattagaaccagcgttctcttccccctctcttttcctttcatctttaaattcttccttctcaattattaggttaaccttaaatctcccttattatcatttgtgtgttagtccttattgaaaaatgtaacagaatagattaatggatttttaatttaagtagtctgtttatttgtaaatattttgatactttaggcttatagtccttttacttatacattcttttatttagttttaattcacgaatgtgagacttgttttctaataattgatatgagtatgaaatcgaaatgaaaaaaacttttcaacgaactaagtaactttccctaaaccatagatatgttacctttgaatgaccatctgataattaggttttactacgtaatatacctagacacatacatgtgtgtgtatatgtataatttttttcttctctaaatgaatcttttgtgttgagaatgcaactaacattttgtgcttaatatgtgggttaaacagatgtctagctcatggttcatacctttcgcatatgtaatactcggggagagttcttctactttgattgagggtttaatttttggaggcacaatccagggttggtggaatggcttgaggatgtggttgtacataagaacaagttcttacctttttgctttaatagacattgtcttgaaattctttggacgttcatattcatcctttgctgtcacaactaagattatagaagatgatgtttcccaacgttacaagaacgaggtcatggagtttggaacctcttctccatttttcactgtactaacaacacttgcattactccatttgttttgcttactagccactttaaaagagttagtcctttgcagagttgctttaactggtgagaaaatggcattgcaagttctattgtgtgggtttttggttctcatcaatttcccaatataccaaggccttttcttaaggaaggacaagggcagattgcctagctctcatactattaaatctactacactggctttaagtgcatgcatcttcttcaaaatatggaattaagtatattaaggtagtctctgcttttaccttttgattggatttttttacaatcacaatgtagtattgttttggtggaatgttagctttcaaatgataaacaatgtacttgtggtgtttttagttggaaaagaaaggaattttattgttttccaatgattttatttttataatttaatggatatgcactgttaatgtatacaaaaaattactttgtcaacaaatcaaaaatcacttttggtatgacttttaaagttgttatagtaagagttaataaatttatcatgtatgattatttgtaatttatgactagatgacatcataaaattgtttgcattattagtgcataattcattttctcttatttttataacatttgtaacagggtattgaagctggtgagagtgattgccaatataaaatggatgagtcatgaacaaggagtgactcttggaagataaaaaagatcattaacaaaaaaaacacatggatgaaatgaatatacattggaattagaaaaatctaaaagttgtgcaactataagactatgtggttaaacatgacttaaatgaattgattaatattacatatattaacaaaatatatattttttgataatttatcatttaagaattttataattaagtatacttgatttggagcaatttttatatgagtaacctttgaaaagttttccatgatacatgtaacaggggtcaaagcatgcaaaaaaaaaattgtgttgattaattgggatattgattaatccggaaagaaattaggcattccaagactatattcttgtcaaaatataatattatatcaaccattttctcaatataaggaagaaacaaagttaagtttttcgtatctcatttcacttatcttaagctagtttagaagcatttaacacccctaagtttgtaaattaccgtctcagttttctagagtctggttatttctagttttatttttttttaaaaactaataattcaaatatttttttttttttatagacaatggcgttaatgaaaattgaaaattcttatattacatttttttactacaaatcatattaataacttaacctttaatttttttgttatgaaacttaatctttcaataaaaaagaatattaaaattttaaaatgttacaacattgttcgttttgtttgttttttcgttaataatctatatgtaagttatgctagtggttaaatcgaacaagtaaatacttgaacaaaggtcccctaatctatatttatattgattgataatgtaaaaaaaatataaaagtacacacacacacatatatatatatataatatgttttaatttttagataattttgaattattataatttattattttatttccaagatcaatattttgtgaaaaattaaaattttaatatttaacaccttgttcatattataatttgaaacaaaaaaaaatattcaagaaagaataacaataaaaaatgcctaactatattattttttaagattaaataaattttgggtcactcaaactattttatactctgatttttattctcttcaaatttatttcagataactaatttcagtccctaaaaaattatgtgttcattttaatttcttgtttatttttaatattcaaaactattccttgagaggatctaaaattgagaagaaaatgcaaaaacttaatctcatgggtcaattttaagcaataaaaataaaaaaaatgactaaaaatagataattttttttttaaaaagaaaataaaactagtcgtctgaaattagataggactgcaaaattttaagaggtactaaaaataaaatttaaaatagtttatggacaaaaaaatataaacaacgtgtaacaagcaaatctctataccagatagcaaaatgcaaggcccaaaagggagcaccttttgccccctaacaataaaccacttttatatatttggataagagtttgttttctttactcttccatctccatgttgcaaactcacataattcatctactaccctcaactcctatacttgagaattcgttggaagaaactagttacttataaacatgttttctgttgaatcttttacacaagagcaaccatgactatgactccgcaggaggaccttgtatgcaacaaaaccattttttctgaaaatcaaatgaacgttattcatgagaggggaaatgtaaatacaaaaaaaaaaaaaaaatcaaacaaattataggttcaacaaattatccctatactacatcaactaactatagagacaaaaattagatagttcattcaacactactagcagacatctagataaaggttcctcaaaccttttgaatgcatattgaatgaactatactaatcatctagatatcgaatgaaccttttagcagacatccagtcatctagatgcaaacatattaattgaatacatattgaatacaaaaatcagactatactaatcctcaataaagagatcaataaaagtatcatatttggttacaacataaaggttgtaattgaatcattgttgccatatgggtctttggatccacctaactttttaatcaaggacaatgttagcatcgtgtgtgtgtgtgtgtatatatatatatatatatatatatatatataggtagctcaggcaatcattctactgtttcttcattcttttgaaacataaatacattattaaccaagaaaagaaaaataagcatgtaaatgcgcgaatatcttacactttgtgttttgcttgaatctaacggaggtcttgtacgaggattattaacctttgcaggtgaatcaggtttgccacctgtctttttctcatttctagctttgttgaaaatcaccgtgtaaccttcagctgaagctggatcattcacatcccattcaccaaactttggtagtggtcgacccgtgtcctgagggttattcagatttgtttgtttaaaatataattaaactgaaaagccttatatgtgaataaacttgatatgttacatacttttttatcctaaaagtcagacaatcaaataagatcatgttaccaaaatcaagaaatggaaaacaagtttaattatatacgtgaccgtagaatgaaacaaaattattgtgaaatatgattcatggatataaggagcaaaattgaaatgaacaagcaacatgaatgagcaatcatagggaacaaattaaatgatcagaagtaattcatagaaatttgagatagtaagagaaaaatgacacacaccgacatgaatacaatgttggaagattttccggcggggggaaaatgagtgaggaaaaggaggagaaaatttagaaagagagagggcgttttaaagaaaatgaaagaattttggcgtttatatatatatgtaacgtgttgaacggaaatcaatgtgcggtggtgtagggagagactaaagaatgtgtgttgaaaaaagtaacgatgtggaatgggaaaggaaggaagaaatcaatgacgacgcatccacatgggcttactattggaaggtggaacgtctcttgaatgtcataaattgatttgattaatgttaacaaaaggttatttatttatataataattaatttggttacgtttataaatggtattttttatataattaattcaattttgattaaaaaatatcaattactattaaaaatgataaattatattacaattaattttattgctttaatggtaacttgcaattaaaattaaagatatattggattaagattttaaattcaatgaataagaaatgatggagtttggataaaaaaaattaaaatcaacataatttttttaatcttttaataactaaattgattataactttatgttctcgtattaattcttattgcaattttctcatttttcacttttggatttgaacaatagatttaagatttaaaattatatatgttgattttcttattttttttaatataattactacaagtacttgatgataaatttaatgacatatttaaatgggataaaagggagtgatgcggatgaaaaacttgtaggagggttactagttatgtgaatgataaaattaagagtgacactcaggaaagcattgcgagcatgtgatggacatagttaggtaagaaaatcatggttaatcttatcacaaaagataaacattaatttagaaagcaaatgaaaaagtgtggaggaaaagagtatgtttgacatttttttattccagaaaaataacataaacatatatgacacacacatcttgaagaatattaaagagagaataatatatgtgtaatgagagaaaagaaagtcagataaccaatagaaaaaaaaagagtctaacaaaatcttaaggatttgggtgagattgttttatactaaaaagtatgataaattctttttaaaaataattcatcaaaaattgtatatttttgaataccaaaagactttttataagttataaacaatcttaattgaataccattggattttgtagcctttattgaaaaatcttaaaagtcttaattgaatatttctatacttatttatacaatttaaaaatcttgattaaataccacaagatttttttattaaaaaaaaatcttttgaaatctcaattcagtacatctctttaattaaaatgggatgtaaaaaagtatataacggaaacatgattccattacgtattttttatgaaataacaatgaaatcatgtttctattgtgtattttttacaccctttcacacaaagaaaatatgattttgttgtgttgtgttatttgtggtaaaaaaatacaaagaatcacaattgtatattgtataatgcaagtgaaaatatataggggcaaaaaaattaattaattgcactttaaataaaaaattatgaaaataatgtagtttccaaagtatatacaaatgtatagcagtcaatcacgtcccaggcagacgtgttcaaacacgtccacacaggacgtgacccagcaccaatcacgtccatacaagaagtgactcaggaggtgacgacacgtgtcattttgagacacgtgtcattttgcggcgcgatgcataaaaacttcggaaggtcataacttttgactggaatgtccgatcgaggcgaaactggtggtcacgcactcaaaatcgagacgagaagccgctagcaagtcgcaaaggagatttgctcaaaatttttcccaaaagaggcctctaagtacctcaaaattgtgattttatcttcgatgacccaaaaaatttcttgttttctatttttcttttattcaattattgaattacatgctattttttatttttctaattacttctcttatttttgagcattttgacataaaatccgcttccatcggacatttctatcaaaatttatgattattcgaagtttatatgcatcaccaattttaccgtataattttgttcaactgttgaaagtagtgttgcgactacaatattgtcattttttaatttgttaaaccgaaatcatttaaaaatctacaatataattttggtaaataaatataccaaaaaaatagtagggtgtgataggaatgtccgttggaggcggattttgtgtcagaatgctcgaaaataagagaagtaattagacaaataaaaaatatcatgcaattcaataattgaataaaaaaaattagaaaacaagaaatttttttgtcatcgaagataaaatcgcaattttgaggcacctagaggcctcttttgggaataaattttgagcaagttttcgagcgcgtggccaccagtttcgcctcgatcgaacattccagtcaaaagttatgaccttccgaagtttttatgcatcgcgcctcaaaatgacacgtatcgccacctcttaagtcacgtcctgtatggatgtgattggtgctgggtcatgtcctgtgtggacgtgtttgaacacgtctgcttgggacgtgattaactgctatacatttataatactttggaaactatactatttttgtaattttttatttaaattgcaattaattaatttttttgccaaaatataggtttaaatatgttttttatttctaatatatatcctaattttgtcttttattcctgataaattttatcttcgaatatgtattttttttttcttttgtaacttaagtgataatgttatcagttatctaaaataaaacttttaaatataaaaaataatatgaaattttttattaggaatcaaatacagataaatattaagaataaaaaatatatttaaactaatatatatacaatagaattatgcatataatatacgacgaaattttattttcgtgaatatagaaattttggaaataaaaaagaaattactcacgtgtagtttaaatagtactgtgattatgacagtgaaaataatattttccctctaaattgattttaaaatcaatttagctattgtgacaagcagtggtttctttttctccaacccagttaaacattcactagatagctcctttgcagctcgtttagtactagatttgtagaatgaaattccaggaagtaattctctgtggctctatccccaattacgtgacattcaaattcaatgaaaaatgaagaggctgcttatgagttgcggctattctattctgtctctccaattcatcatgctttgaaatcaagcatttaccttcagtgagatactgcatttccagaacagacattttgattactctccacagaaaagatttatatgagattgtcagcaagttctatttcaccaggaactttggaaggatgatgaattgatgacattaaaataagcaaagatacgagaagattaaactgtaaagttccgaatggaatgtccaagcttctaagatttctccaacttaatacatattctgatgcagctttaagaaattcctttaagtgtaatgttcagcagctgtttacagggaatgctgtttatactgttatgctgctaattacagtttgtttataacgattagaggaatggaaaatctaggaccttgaattttagagttaatagctgatcttagtccgtaattgttgaagttgcacagcaaaggctggttatgaatgcaagttagaagcgatatgctattgtgggaaaaatattctgttaaggtttaaaaaacatgtttactttcgtttaattggccgagtccttactttcgtttttgtcttggcttttttagtatatgatagtaaacagtaatgtaatcttcaagcgatttgtttctggttactttgggccttcctgcgtagtttatataatgtaagtgatatctaaattattagaaattagttctaagttactgaaagcaataaatcaattgttcccgtgaacccagttgtaatactactcaattgaatactagattggacatttaatcatctgattagcttctaatgtatttttttataaaaaaaaattaccgtaaagttttctatagtgaatagtatattaacaccttttctgctgaaaagtgttatttttataattgaaagtcaatgaaattaatgtttctatgcataaatatcactaaaatggatttttttatctttttctcaacaaagtcttttttaaatacacaattagggaatcaaatgtctatcaatatgcttatggaacataggtatctactaactgggttggatcttcttggtcatattaacaccttagagaaatggtatcaatgcttgtcatcagttgttccatagaagatgaagataagcataaagcaacagttaaccgtggttgcatatacatgtacatttggcttctccgaactatgcgttgtcatgcataggctataactagataagcaagattctaattgttgtgcatgtctacaacgtgtcatgtaaactgttatcctctctgctcagaagtcacaagtaataacaaacaagcctacacagacaaacaccctggtccctgacattaatttcaaacgcaaaacagcaaggcaggtccataaggggtggtttggtaatagataaagggtttcattatattttatgattttttttaattcagagatcatgggtgattctcaatctactagattataaactaattctattcgtgatacatgattgtgacttgatccaaagaattttaatagggtgtaaaccgaacatgaattctcttattaaataaatttttttcatacatataaacgcaactaagtcttacattattatgtccatcatttgaattattaaattttatgaatttattagaatgttctgacaatgcaaatttttatataatattatttattacatattattatatattgtaagtatatacatgaaattatttttaattagttacctatctaaaaatctaaagagggttattgcatgaaaattaaactcattttatttgcgtgcagaatgctacctaagatcttattcaacgaagtagttccttggctctagccaatttaactaaaataattcgcggctcaaacgcaacacgacacatttctggtcgaacactacaaaccttctccaggtctctgatattttggcacaaaacttcactgtctcaaattaaacctttcggctttcatgtgttcaatcgatttaccatggtaatttcttgttatctactgagtaattattttagtgggtcctcctggggttcagatgacacatgccagcgtaaaatttactatatgtactaatttattcttaagaaaatatatgagaaactgaaatttacgtatgctgatcatgaaaactgtatcctacaaagctgtacataacttcttgctttttttttttttttaatacttaaagcatgtacgtaacttatataaagtgcaatttccacgcacttactaattacgtgtgtatctttaacttaatttttagggtgaatcttggccctatgttatctctgagccaagagttacaaagattaactccttgtcatagatattaagagattaattaacttttcttaacaaatatttttttttatacacatgcatattttaagtaattatcacatatttaaatgataaagttatttgttagttatgtcacactatgatgatgtattttactcaccaaactaacaacaaaatggtaataacttatggtatcaaaattgaagtcagttaatcttttaaagcatattctaaattctaatgagttggcttaattattgttcttcatactttagtttttacttgagtttggaactgttttgttatattttaggtcaaaattcttgaaattatgtcttatcatatcttattccttaatcctagggataaagtatgataagatataatcaagatatgattgagatttgttatagatgttcaagatatgataatatataataagatataagatgataagataaaataaaatgtttgatcttttagttatttagtgtcaaaatataactatttataatttgcctacttgtaaagataattttaattgaacatgttatttttatcgattttttagactattttgatatatatatcacagtttttttaaaagaaatatggttgtcggttattttatatatgaaaggaagaaaaaatagattattcaaatttgtgcctgattaataaaataaattgtgaatgatttctaagagaattatttaataaaactgaaaaaaaattaagattaacatgatacacaaaaagggttatcttcatgcaattattattatttttttaaagaaaattgaacctaatcaactagccatcattcttaattaattacttagctaatgatatgtttgaatacacaattctacatttattagaccaaatccctgaacagcagactagctaatatatatgcctatgtggtttagctagcctgttcagagattggtctaacaaatgtagagatgtgtacttagcatatcattaactaagtaattatatatatatatatatatatatatatatattatattataccgtacgatcggttaaattcaatgagcttgatgttatataagaacagctatcttccatggtgtgacatattcagctttcatagagtttttatttgatacgtttttctctcctcattctagagccttcatcttgttcaggtggcaaaaaatgtcttcatcttccctctccataactccattaatcttcgattcaaatgcttttgcattctcatatcgatccctttctttcctctgttggccctttatattcttacggtccctcaattagatcttccatattattaatttgttctttaattcctatatatatcaaggatcatgcataggtgtacagaaggagagaagctttaattggtgaggctgatttgggaagaagaaagacaaggatcagtatatatggaggtgaattattcatgcttaattgttaactcccgttgatgagatatacagcatcatgtactaataatctttgtgcacatcaccccccacaccccatctcatttctaaagaatatagtatatatacaagtacactagctcattcaataatatatttctaatcagcatcatagatatctatttcttacattaagagaagcctagctacatgtcccccctcctaatatatccttttgcaaatataagacctaagatctaaaatcgattgatattttgaaggatttaatatatagatgacagcatatataaaagtaaaacatgaattaaattttagagatcaagtaattttctgaaaaactcactgccacttgattgtgatctacatattcttgaagttatttagtattattttctcagttttagggctattatttcccaggattagggctagggccattttctcagttttagtattatttcaaacttgactaattatgtgttaaaaggaattagtttcacatcttaactaaaagttgtagagatatataaaagaagacgaagatttaagtaaaattaattttgtttagatataaactacataattaacatatgattggtagaaaaacatgtctctttcgtttgtacgtatacacatgaattcaatatcaatatatatatatatatatatatatatatatatgtacacatatatataagttaatatcttaaataaattttaatacttcaaaatattagtcttggattttcagttagaggatacttaagatttgtaataaaacttacttgatgtaatttaattaattataaatataatatacatatttagaccaagaatagagtagggaaaaggaaaggaatagaaatatgcttgttttgatacacgaaaggtccacatgccatataattattatatatgtatggtctgattcaaatgcatgcatgatggtgttattgttcataatggacagggtgatcttgatcacgagtggaaatgcatgtcttgaagggttctattggtggttaggaatggactgtgatgagtgatgtgagatatctcatgttgacagaagagagagagcacaacccgggaatggctaaaggagtctttgcctttgttgggagtgtgctctctcttcctctgtcatcatcacattcacatgcctttgctttctagccaaactagacgtgtacatgcagcgtactgccttataccatttaaggtatgtgaagcttttctttgcctcaggttggattggttataaataatgtcgttttcaaaaatattgaaatggtatgtcaaatacgatggacatgagaatggataaattgtaatgttccttgacatcactgtaatacatgcatgatgtttttcttcaaaaaataaaataaatcagaattcaaattaaagaaaagggaaataaaagtggataagaaactctattttatattcgttgaattttaccataattatagtaaaaataatatcaagaatattcttagagttcaatggtaatctactaatagggataaaaataaaataggttatactagattttatataaataattaagtctgacctttttaaaagtttaatctatcttattagtctatttaaaagtatactaacaagataaattttaaataagctaacaaacctatatttaaatatgtcgagttaaacatataattgctattaaaacttagtttttaaaacagacaaaaaaagaaaacgaatgtaacatacaatagaaaaagtactaacataaaaggctaacttaaaagacatatgataaagaaaaaaagctaatctaaaaacatgggaaactaatgtagaacgataaaagccatatgattcaacaaggccgtgaaactattagtaacttacagattatattgtcagtcatagcctaattattatttattttgatatattaaataatatgacctttggttttattgatttatttaattaataatgttattattagtattatatatatatatattatagataaatagacaaggcctaataattattttttacaagcctaactttagcctatttaagtaaataggtctttttaaaagtacaagtctaacatttttattaattattaagtaagtcaggtcaagtcatattctcactcacaactgtaaaataattttacattaattatataatcataaattatcatatatgataattatgttgacttttataataaatatattaaaattcatataaaaaataattttttattagatataaaattaatttacactattcatacatcacccttaatctcatatttgtattggttgatatagtaataatgtaaaaaaaaatttacattaatattatatatatatatatatatatatattaaactcaattttcataacatatagaactgtcctacataaaagtcataactgataattgattttaaactatactactatatacgtattccatgaattgtagttttctgctgttaaaatttgggagaaaatggtgaccaaagaacatttctcaatacaaaatgcagagttcaagatagaaataaataatgcctcagcggcttcccctttcctttcctagttatttccaagaacaatttttgtaatggggaaaaattaggaacacattcagtaataaaaaattgtttacttactcattttcctttgtcaatacactgataatttgttgcgaatcgtctgagagaaatgattgtgatgatttgtgaatatatacgcgcggtggcatgatgaaaatgtgagaatccaaatcatcaaccaacaaaggagccattttctttttgggatacaagagccaatttggattctacaattaattaaggcgaatatttgtcaaaatattattttattggaacctttttatatttagttggtctgcgggaatttaatggcatgctgatatttcatatttcagctagctcagctcagaaaatgacctcttactttcgatcttttcatttctttttgttttggtggtgttgcttcttgtcaaatttctagttttgtatataacacgcttttaatgagcacgcttatgcaccaccataatgggtaggaaaaccagtacatagttacatacatggatataaaactaaagcagacagtggcttttgtctcttgattaaatgattcaaggttttaaatcttaattaattttaaagtttgaaataaattgtttgtgttaaaaaaaaaaaatattcactattatatattttggatatgaaagattaagatatacacaggtgcaaatagaacgtgagttagaagattaagttgtacatgagctaataggatgtgacagcatttacatttggttgttccaaattatataaacgcattggcatgcatattggacaataaccgaaatgagtaagatatcgattgttacggcatgtctacaacgtgtcaagggaaatttgctttcctcacaagtcacaaagttagaacaaatgaagcctacagagcaaaaatcaaactgaaacgccaaaactgcatggcattgccaggtccacagcggtgacgatggttcttgttgggagagttttaacttattactaggagtgtggatccggtgttttacgtgacagaaaaggggaaaaagaagaaaagaaaagagaaaaagcaaaatgttaaaaaatgaaaaaaaaaagaaggtaaaactgtcaacttatgacatatgatgacaatagtataatttttatatagatatagattaaaattatatttgaatatttaacaaaatatttaagttagtttgtaattttttttattagttgaaaaatttgtttgattttttgataaacaaatttttataagtagtttctaatatttttttaaaattattttaagtaatatttttaaaagatctagcttataattttttatatttttatttttaatatatttatctaatttcttaattataatttttaaataaattataattttattattttttattatttaacacttttcaactaattcattagttaattttatcgaatacttaaaatttagtaacctaatttttcagtttgtgattacagttaattttcagctaattttgaattttgttaaacataacctaaagttgaaaactcattagaaaaatcaacatttgaattaattttgtaactatggaagtatgtttgcacaaaatagccaagcaaaatgcgagaaggacaacggatacaattgagcgtttctacagaggtacatcgaaacttgtaattgtgacagcgaagaacagtagcaattcaaattatattcatatgtataaactgacaaaaaaattattgtaacgtcagtctgccacctactaaatcaatttcttttagaggtgagaaagagaaatgtatataaaaaaaatagtgaagctttttaaagaaactaaaggagttaataaagagattcattccatggggagaaattcaaagtagcacccttaattgctttgtttttttttgctgggtacaatcttaattgcttaatacatagtttttattttactttctccttttaaaaaatacatagttttattttcttgttattactaattctaacatctttagccttcaaccctttttgatggtttgttcaattaccatgactttccgttccttgagactggtataaacttgtggtcaaaagccttttgcttctgcttcttggacacaacgttaacatgggtgtgatatcatgacattaggctttatattgaagtcccttataaaatgatccgttcttgcatctgatacttgttgaacttgaacaaggtctttaattgcttcaggcataggttggtcattcatcattttcttccaataatcccccaggtcttttcttgcatggcttaagttgatgttggcaacctattagtagagataacattgaaaagtcataaaccatgcatctcatgacaaactcaatgtttcaaatttatgagttgcttcagaaaagcttaccaggagaagagacaagattgcgaacaacgcagagattggcttcatttctttgctaagatcgatgtgtgctcctccttatagcatgattaagattaattatgctctagctaccttcacaacataacatttttcttttagtacttgtcatccgagactaaaacggactaaaaatgtatatgtaggaaataagttaaaaagtatacgtgcaatgattaaaatataaagattgtgcaaatatatggaataaatgagtaattaaataaaaatagagtagattacagttaaactccctacttcaggttttggtgagattgtacaaactcccctcttttggaacgtttacatcaatccttgattgggatgatgtacatgtaatgtttttgaaagtgtaacttttacaatggtatgcaaggctttaacatgctctttgcctctttcccctacttctccgtgagtatctattgcgatttacttttgtttcagtgaagaaaacaattccatattatttgtattgaaaattaagttgtctggcaaattataccattaagtttgacacagaatgagaccaaggcccgtattattaataggggctctgattaaaaattctgaaatgaaacattacagcatgattgctaattattgctgaagtcataagcctttgaacaaaacccgatcagcctaatcctacttggtagtagtagtaatatacaaacatctatgtcaattttctactttcctcattctgtacaaacaccatgagaatgagagcacctaaaacacggttttacttattagaactatgaccaaaacaaaacaacaaaataagcttcgtctattgcgctttgaacatacatagcttattagccacatgaaattcagtgtattagctctgtgaatgaactatcactatgtaggatatgactcgttagtttttgagactacagaatagcagagtatagcattagaaatgatcaccggaaacaattaaagaatgaaaagaataagttgagttgatcagtcaattttgatctcgcacatagagtcttgatcagcctctgaaacaatgtcctcaatagtgagaggcagaggtaggtcagaagagaaggtgagtgttggcttcacttttggcacaacaagtggtgcagcctcattgtttagaatttgcagcactctcctcatggaaggtctctcagcactatcaggattagcacaactcaaccccaaaagcaacaatttcctcatctcttcctcctcaaactccccattcaaccttttatcagctgcctcaatcacttttccttcagagtgaagcccccaaacccaatcaatcagattcaacatcttagacccttctctttcaattggcctcctcccacaagccacctcaagcacaaccaccccatagctgaaaacgtcagtcttatcagtggcttttccatactgaagatactcaggtgcaaggtaccccattgttccagcagttaaagtggacacagggctcttatcatgatccataagctttgccaatccaaaatcccctaatctagggttgaagtttccatccagcaatatgttcccagccttaatatccctatgaatcactctctgctcacactcttggtgaaggtaaaccagcacagaagccaaccctagtgcaatgttttgcctgtgagaccaactcaaaagcttccccctttcaggttccttgtaaagcatcttgtccaagcttccattgggcatgaagtcatacacaagcagcaactcccccttctcaacgcaccaaccttgaagttgaaccaaattcttgtgcctcaaaccagcaatggtgttgagttcagccagaaactcagtcttcccttcgtgagaatgtcttgaccttttcacagcagcgatggttccagaagatataaagaaagccttaaacactgttccgaaagatccatgcccaacaatcctactaggatgaaactctcttgtagcagacttcaactctttgtaatgaaactccctaggataagccacgaaaccactcttctgaaacttgtctttctgtctatcttttctcccaccattcttccatctccgaacaaaaacgaaccccaagaatattgtgaaagccacaaagaaagaaacagaacccgcaacaatgccaacaaccctcttgtcacgcttcttcgtggcaccagaacgtgaaattcccaccacggaaacattatgagggtggtgcaacgtggtggtgattgtttctgtgtgaaaggtccaatttttgatatggtgaagctcggtgcttccctgagtggaagcggagaagccaacatagacggggtctctgaggtaatgagaaagatcgaacttgacagagaggaggggtaggaggggttttgaagaacgtgaatagctcaagaaaacgttcagtaatgtgtattgggtgttgtagtctatccatgcagcgatggtgttgccgctcttgaggtcgatgccctcaaagatggggtctccggttacgagggacttcaaggagtccacgtcgaagcccacgtggttctcgttcgggtcgtcaaagcgcgcgtcgaggcgcgtgtcgaattcgacggcgacgaagctggcggaggttgggaggccgagagggccagagagggtggtgttgggggagaggaagaaggcgaggccgtcgccggaggaggtggggttgaggttgttgatggagaaggagaaggtggtggagaaggaggcgtggaagagggagataggttggctgtagacgacggcgccggtgctggaggtgggggcggcgttggtgagtcttacggcgccgttgtttctgagagaggaatcgccgaggagggtgatgttgttgagagtgaaagaaggaaagtcgaagctcacgttgtctgctactgccacctcccacgagaacaacaataacaacgtcaagatgaagaagaagaaagtgaaatccatggccatgaactacgtggctccaagaatcaacaagaaaatgaatggagaagagaagtggatgttgtgtgtactgcatgtggaggctaggtatctttattttgcatttttttagcactatgtctatgtgcattatcaacttagttttttatcctaaaaaaaattgactttataatattaaggtatacgctattatcatctcttcagtgaacgatatacattattcataaagacattttccataataacaatcatacatcaaccaaagtagtcattgtaatatgaatgaatgaggtagacttgaattaaaaaataatcgacacttaaatgagagaaactattgtcaaaaattttactttgtaattaaggtgtataatatatgaaattagtgataaatatactttaaaatgcaatgtcacatgaagaaaaagaatatattatataataatgatgaaaatgcagtattatataatgaatatatagtgaaaatagttttaaaattaaggtttaatgatatgatgaaaataagattaacaaacatagctattagataaatgtttatcatcttttatttcatttcttgtttaccattttgattcttaaatgatattttattaaaaatatatatgtattttggaagtatatctcccaaactatggattagagttccaaaaatatatttctgaaataaatatatgtaattctgaaaagtaaaagggatgtacatctttaagaaaaagggtataatgaataattgagaggaggggtacaggggtgtacttggataaaatgagtgtaaatagcaagagcctaaagttcctagtattgttgggccacctttttgaatggaccctttcaatgttgcgtgaagtatggtatgggcatggagtattggaatttgacgtcttcgtgttcaacgcactggttctcatcaagtgtatataactatatatttgtatgtgtagtattcttttcatttcattcatcgtcttatttggcactccccatcctcggcttctgcttctgcttcgtggagcaccctcaatccgtcacccaacacacccatgtaaggttctcttttctgtaatttaattcactacaatgtctttttagaatcacagcagaaattaaaaatttgtctgaaacctgtttatgctttttgttggcaaataataggtactaatttggaatttattagaaaggaagacatggttgggattcatgtttgtaatttgagcttgaaactctatctcttcgtgcttaacttatttggagcttgtaactggaattccaagttcaattaatccatcaaggaaaaaaaacaagttattttgcatttggatttcagcattgcttgtttttaatggtttcaggtcatggatgttccattgccactggataaattggctttagatttgattaataatgaaccctcccctgcaaacacgagcaagtatgttcctgtctgtattatttatttatttatttattttgtgagggacttttcttttgaccttattattaattaattatgacattctttttctgtctctcattaaaacagcagcaagatatatgtaattctggtagcaactggaagctttaatccacctactttcatgcatttacgcatgtttggtcagttgcgtttccttaagtttacagtgcagagacttgttattctactgccctgagacatctatacttttttggtgcttataaaactcaaatctgaataattttaactccttcccctcctctaacaaaaataaatgacatcttgaatataagttcattcttgaaggtattgattattgaacaatttgacacttttctatttttccattcagtgtagaagaattaaggggaaaaaaattaagatctcatatacatcatgtgaaaaaaaataaaagtcaatggttgctcaatagtgtagtagccaaaactgcatgcatgataatcactttaccatttacagtggttttttgcattttgtgatcaaaccatatgttaacaattgttaaaatatactcactataaattatataataatataggcttctttgtctacttgaattaatattataattataaaatccatatacatataattgaatttgttattgaaaattctatgctgtacttactacatagatgttcaaaagagttgggtttgcctgggaacaattcataccagtgtatcttcttgtattgttagcttccttgagtcatgatctctgagtttctactttcttaatgaaggtgaatgggagtatatgttgaatattccctctaattcacttacttcttgatggaatttcattaacttaatttcttgaattatgtgcaatttaatttttaatttcatttattctctgctagtctgatttttttaaaataaaatttgtgggtgttacccttagagcttgcaagagatgcgttgaattcagatggctactgcgtaattggaggttacttgtctcctgtgaatgatgcatacaagaaaaaggtatgaagttgtcaagcaaagagagaaaaagattcttcatttattatatccatacatgcgagtctgtaaaacttgctagcaaaataaatgaataaataaggtaaatcatatgcttggcatgtggaaaacactgaaacacttgactgagtttttattttacttttttcagcaaatagatcaaatatgattctatgaatgaaattatgatttttattaatcaagtgatgctattagtttcactgccacatgttggtctaattgtattttgcttgcttgcatgtttatatagggcctaatatctgctgaacatcgaatacaattatgtcatttagcctgcaaaagttcagattttataatggttgattcatgggaggtaattactctttctatcagctaaattgcatgtcttcctattttctgtgcatgttaataagtttcattatccatagatttgaatttgagagacaatgctttgatgtcatgcgtgttgtgagaaatatttggctctctagctaacctgatttattaatattttgcatttttatccggctataaactgctgcaggcaagtcagagcacatatcaacgcactttaactgttctctccagagtccagaattcagtttgtgagacagggttggtatctagaggtatgctcaacaaacaagccttcaatgaaatcacattactctaattgccatttcaaattgctcccctgccccatcttaaaattcaaaataaaggaagaagtgacactgacaccagctgtcttaatctcttttaagaatgaaatactagtcacattaatggtaatccgtactgctgctgaactttttaaaaaaatgtggtgctaagtgttaggaatactttgtgatttaaatgattaatatatggattttaatgtttggacatgttttcctgtctctggcattaggtggtcatttgactctagtattttgtgggaatttcttagtgctatatggatgcatgattggatgggcaatttggttccatatggtgctaaagccttcaaaagttatctattatctatcttttatatatatatatatatatatatatatatatatatgttcattgacttaaatgtgttttagtgtaaaaggagcattaatagttccctcccttcattaattaaaaatgccgtgctagattttcatttctttctatgcatgtttttgacaatgttgtaacaatgcaataattttcttttgtattgatttgtgtagaatccctcaaggtcattcttctctgtggttctgatctccttcattcttttagcattcctggattctggattcctgaccaggtactataacggaaaaatcgaatattatttatcatagattagtttcacatggagttatttaatgattcttggaacaaaataccttgtcccacctaataaatttgataaaccaaccttaaatggttgtggaattcaaagtcagaggaattatgttgattttgtgtttttattgttagaattaacaagcttattgagtcaattattcttatttcttaccacatagatacaaggcatgggtggagtatagattaggagtgtcaaactaatgaattgcataatttttttgaattgaatccatttatggtccattaattatgtattacaaaaatttaattcatccataacttatttcattaaaaaaaggtccatccattatattttatttttttcaaaacaatatttttctaaaacaaagtttaatatttgtacacattcttacacccaaataccatagaatccaatatttgtctcataaagacctatgtccaagtaatgaacttggaactacttgattcactggattgcaaaatatgttggatggttcattatctatccaataacaaattggtaatccaattcaactaatgtattaagttttatttttataattgaatagattgattggttgatttatacttgatggattggacggttagtggataaaacgattgaattgccacatatgttaatgaatactaatttgccataggttgtggaaacaatgaactataattttgtttttgtacttaaggttaaaactatatgcaaagattatggagtagcctgcattcgcagggaaggacaagatgttgagaagactatatctaaagatgaaattctgaatgagaataaggtatctcacatttcaagcttgtcctatttccccatatgcgtttaaaatgaagtgttgcttatggacattttcaaatatctgtttactgtgtatttgtattttaccgaattaaggtcaaattatagaccaacttatgaaatccttctgtgatgtcccatatacttaggtgtgttgatgttcgatcaacacgggaattttaaatttaatgattaaaatttattatctttttgtttgtacatgtatgtgctagcgcacatcgttttttgttgctgtgattggttagaattgattaattcctctcaaccttgattactgattagctgttaaccttggacactttttcttgaggtgtcggagtgtgagacatgtgctgcagtaacacccaccttcttgacattttgttagacatgtgtcggatactacttaataagtgtatactggaccttgctgtatgacttggatacttgaaccatgataccttcaaagtatggatggatacttcaaggacactagtactatataaactataatatatatatatatatatatatatattcaaatattcagttatgaaacaaaattcctgggaccagagtttgtattagcgttttgttatgtaatgaacaataagaattagaatgcattgctttgctactcagcttttatacatatttaaattttccactatttttttaggataatatcaaagttgtgaatgaacttgttccaaatcaaatcagctcaaccagagtaaggtaatgctatgacattgtttactttcaagagttacaggacgataatttttaaaaaagagagacgttcaattttcttgtctttttcactaatctcagggattgcattgcaagaggactatctataaaataccttactgcggatgaagtgattgattatatcagggagcaacaattatacttgaacttaaatgataaatgattactactgtttttcattacattctgtagacatgggtctttgcaagagccactgcgcatcgctatctgagccaattttctataaacagatgatttttcatttttgtgttgtaaatttgctgataaataaatatcacataatttatgtaatcgaattgcaaatactactgttgaagttgctcattttaacttttttggataacaagtgagtgaaaaagtcttgcaatatagataggaattgataaattgagcaatacttaaagtgcgaagaacacttatacctaatgcctttaagactgagttagatgtagtatgttaagtttatttgttaacggttgatggggatctctgcaatatgtttgttctaaaaaaataaaaattgagccagggatattcttgattgaagccctgatttattgaaatttattcaagtagttggttgttctcaatagaaaatttgttagtataggcttaaactagtttttatcccgtggtgatgttataaggtagtaaaatttagtgtcattgttggttttaaggtagtaaaatttattaaataatgaagtgtcaacacagatttgatgttaatttaaaaaaaattaaactctagctaaataatattatataatcaattactgagcacactatattttacattcagtcaacttgatataggggcacgaaaaagagaccccatacttaatatattaattgttccatacattttaagacaactttaaatatgacaaaacaacacacgttttttttaacacaataacagaaaagctaaaaacaaaatgtataaaagagcatgttgtagcacgcctcctatatattgaaccacactaaatgcatttcttggatcgttgttgtacttctgccacgattaaagtaagcaacatgatgatcatagcaaacattggcactgctactagaaccaccaccaccacttgacacatcaccataaaacccacccatcattgttcccattgttgggtttcgaactattggagggatcactgggaaaacaccaacaaaaaaattttcttgcggcacagcataatttatatttgcaatagttggcagtgtagaaagggacgccgcacgatgtgggactccttatcaatatcatcaccttcatcactcttatagggagtattaatttaaaaatttaagagaatctcagtgtaatatgtttttaaacataaaacaaagtgttagtgtattaatttcaaatttaaaaagaatttgtacaagcaaataaaaactatatttaattatgtgtaatgataaaaatccagaaagtaatttgatcgtacatgactaatacaatttgtgataatcatattataataagaaagtcttagtcatgtatgtggagtgaaaacaggccagctcatgcccaatgagttagcactccggattgtctaagaaatattattcttttttctatttttcttttttaatttgaggacgttattcatctctcgctagttgccatatatatttataattctgaatttcagatgatagatttctttataaacaatcttgaaaactctttttatccaaccttgaaacgatgaaatctctcttgtgcacagtgcactgaagtctgcaaagtatttttttttttttttaagtctttaaaaagtatttcgataggcactttttcctctaaaagtatgacttgttattagttacaccaaccccatatgctcattgaaaggcatttataattcaaatatgcataattaaaaatctatccttaatattaacttgggggtatagcgttgccaaagatatacagtgatatatatagttttaaagcttacaaattacatatacgaatatgatgatcgatcgatctacatgaaattaacaacccttcatacttcaaactctgaacgtgaaacaccccttaagtcaagtcgaaacttgcgagttgtgaggcacgtattattgcactgtagacttatggtttaaatttaatttgacaatcaactttctgcctttcgaaaaagggaaaatcaaaatcttgttcatactgttgactacatccccacccagcattcaacaatatatgcgcaatcatatcctacctaagaatccccgtgtattccaattgtactatcaattataaagtattaaatagggagacatattaattttacaaactatactcactataatagtataattgaggtgatataaatttgatcgtacagtacggatgaattaattaatgatcacttaaagtaaactttttctagaaacacatgacaatttatggcatgtccgttgagaactcacacgagagctgcgcattccatggcctatatgcttgtggtcagatagttataatgaataatgacatattaacactttatgatttcaaagatttaattaatattcatttttctgttttatttctctttagcatcatatcacttataatacatatttatataaatttttttttatccatacgaattaaaaacataaaatttataataatttatgcattttagtcaaccaagtgagttaactcttttaacctatgtttatataatttcattttattttttagctatcagttagaatttgatgtttgcccaatatcatttttttgcattataaattgcaaccttgtaccaccacttcccaacttccattgattagttctaccccctatcctatgctttgaaactttagccttttgaatccctagctataattctatagttaaatcttcttgtgaagcttaacattcagttgagccaatgtcaatcttaccaagttcaggggaccgattgtgtgagggtgattttgagattctccctgccacaaatgatgcccatggaggagtcattgtagatttggagaagccaatggactctgaaattttcgttactctgcttagaacatcactttcaaaatggaagaaacaggtaacgatatcaatgcatacttcattaagattaaggtattcaacttcattaagattatggttcataaaataagatattaattcacgtgaaaattaagtgtaattactcgtcttgtaagtgtacaatttttcgttgtttataaaattcttaagcttcactgatccttaatttctttcaaccctttgtttggataagtcatctacagatcctgcgataggcttgagtgcatgttttcgcttcccgtgaaagccttagcctccagcaccgattgcttcagaatcacgtcactcagcaaattttatactaaccctgattttatataaaaataataattacttaattcatcatgacaaataaaaatagttagattaattgttttgtcataaattttaattttatttcaaaattatttataacattaaataatttaaaatatgattattttaaaataaaaaaatttcaatcaataaatgtgtcttattttgttgatataactcaattaaatacacacttttatggaaaaaagaaagtaatcattaaaaataaaaaataaatttaacaataaattaaagtagtctttatatctgttataattaagataaaaaaatattatcttttgttttatatatatatatatatatatatatagagagagagagagagagagagagagagagagagagaacatcataggtagtaatcgaggctagagataatgggagagacgagtgaatgaggaaaccacgtgtgaaaccatgaattattttatcattttttagatgctccatatatttgcaatcagaaacaagatgttatataatcaatattaggcttttcaatctcatcattttatttttcttcgattttgaaaaacagatcatgtaatatctgcatactataatcagcttactaagaaagactagttcagccggaaaatgtgaacaacttttaattcaagatagtatcaacatttatgaatttgaaaaaagtatactatccaaatgatttgtaaagaaaccataacattaatcctactatcttatcaattataatatacgttgcaggcaaaatgcggtgtttggatcaagttacctacagcattagttaatcttgttgaaactgcagttaaggtaatgtttcctgtttgtgtcagattttaattactttaaccttgtacaaggataaggtatatctattcagctacataagattgttttaattaaattatctaatttttaaatccagatggaaatgtttgtcagattctaatttcttttcttaaaaaaaaagtatatttttagaatgtgaatttggatctaactcaacctcaaaagctagttcaataagattaaattcttagaatatgagtttgagtctaactcaatcccaaaaactagcttaaaaaattaggattgttctcccttatatactctattttaattttatctttagtcgatatgagacttgattttttttcaatatatatatatatatatatatatatatatgcatatgagtttaatttaaacttgatcatgttagttttcactattaaataggaaattattggaaatttaatttaataatattattcagttttttcaattatttaatttaatttttgtaatttatattaaactgattcagttcatcatgaatactatcagtatcagaagacaattttatcgtgaaatcacaatggaaatgatcgaatggatgggatcgagctagagaaactattttcaatataaatgttatctcatttttgtcagatatataaatttttcaatgaatatatatgttggtggcatgatgcaggagggtttccggtaccaccatgctgaaccgaactatctaatgctagtttattggattattcctgaaacaagctgcacaatccctcccaatgcatcccaccgtgcgtgtaaggatcggtggtcttgtcttaaatgataacaaagaggttcgttcaaaatataacaacaatatataatatatggttgcctccttataattgattccttgtttgctttcaactagtaggtttcattttacaactttaattacttttcctctcttaattattttcttttcttttctttctttcttatggtgggcttatatataggtgcttgtagtccaggaaaaaaaagaggtacattccatgaaaaactggcctgtggaagatacctactggaatagttgaagcggtatgaacattttcaaccaaaaattcctccccacgtgttgaaaaataaatatttcaatttgtgtagaaacatgaaattaacatgataacttcagggtgaggagcttttagccgcagctgttagagaagtaaaagaagagacgggagtaagtgtcaatgtaaaatgttgctatgttgcattttatatttgttgttaattaaatgcgcgccctttcttatgttgtattaatataactcaactttgctatttactttccttgttcagattgatacagaatttgtggagttactggcattcaggtctcaattttcttcctcaaacttactttagaaactgaactaaatgtctgtctcctacccttttttcttcatcatgattttagcattagagaatgtaaatatataaattgtctttgccttcactgatgatagacatttacttctcataaaatctgcctttcttctttccctcttattttaattttgttttaagctgctcctcatgtttatgatttgtaggcacgcacataattcactatttgggaaatcagaactgtttttcctttgcatgttgcgtactctttctactgacatcaaaaagcaagatttggaaattgatgctgccaaggtatacagtctttcttttatttggtttggatgtaaagatgtcacaaatgatcaatgagctaactgattaactttacacactatattgccatatctgatcgagtcatgttttgcatgtctacatttaacaaagtttatcattaatttttatatatcaagtgacaaagtagtttttgttctcatcacccaacaaatgatagatattttgcaaggataagaccggatcacataagaagtgacatatatatgacaagacacataaatgaagcatccttctttaggactagctagtattaattgtctaacagatgagccaagcgacgcatatatatatatatatatatatatatatatatatatatatatatatttacacctaacattttaatgcgcatgctctctacaacaaattaaagttcaatggcaaacaaaaaatgactttcattctggtgcgtgaacgtgaagtttgtgtgacataatatgatagaaagttggattactctgctgaatatatatgattacacgccaaactgtgtttggttggattaagcattactagacattttaattgcgaccaaaatttttataaggattatatgaccactatccacatctgattattttgtccccacatttttagcccataaagcaacatataattatctcgtgcgtaggttcggatcgatcacgtcccttgcatagttggaaaatgaccatgcaactcataagaatgatgtggattcttgaattattaatacatgcacatacgatagagggttctatttgttggcaatttttctacatgtttaaggttacaattttttgagcctctccaaccatattaaattagatacgaatattctttcaaacatcctatcgacacattttatttttctttttttatcatatcataaactctataatatttatatttttcatttttctctcacctactaagtgtttaataacatttgaagtgttcatttatcttttttctaactatagttaatacggtaatacccttttctctaaagaatttaaatcatatatgctgactaattaactttacactgccatatctaagtgatgttttccgtactaatgtagtgctattgttggtaatcatcttgtaatttctatttctacggtttttttttttttttttaagaaaaaactatacaataatgagagataaggtggttaaagtgatagagagaaaagaaataaaagtataataaatgttatgtaaacttgttatataaataacttaacttttttatctgtatattattcaattcttttgacttcaattttcatgtatttcttccttttgtcacaaagtggatgccgtttgaggaatatgctgcccatcctattacagagatgcacgagcccttcaagtatgaaaatgaattatgcttagcaaagttagaaattaaggtgctatgctggattttctccacgacctatctcatcatatttataggagcaattgagttatctatatttaaatagccatgacttggacaagtcttccaattcagtcaacggtttgggtcttagacaaaagttgaatgatatctgtttctcacatttcagatgttaattagctgctcgttcttgtttcctggatttttcatgtttaggcacagacacggtgattatgccaattgatcacactagctaggcttcattttatttgatcgggtgcaactttagcattgcgtctaataaaccataatttctctgtttttgccctgtatttcttttaacaccacagattttacatttcgattaattagatgttgtgtaagttgtcgtgtcgaaatttgaacaattcctacacaaaaaataatcttatgactggtttgggggggggggggaatattttgtttatttggataaaaaaaaaatcaatgttttctcccgaaaattttgtcttcattttaattttttttcatctttcaatttccttttcttacaaacgaaccatagtgattttttgaagatggcagaaaaaatatagtaattttttgccccccaaatcttcattgttcaataaagaaaaatctctagttaaaagaagcatttacttgaaagaacttgttcagcttttagtgtcatcattgtactgaactccattatcagcgatagtgcaacatttatcaatgatgaaaaagataagttctaagaagaaaaaaaaaaacacctttaattaaagaaagagaaagtagaagtgaaaaggaaaggttgaaaattttaacaatccgttagcacagagactcatgcaaagaggaagacatttgtgtgttacttcaataatatcatgacagatgtgctgccatgcggcaccatctccctagtgtagaagaaaaggaggcgaatgatccaagactgcattaaaaacaggtgctggttgcaaatgaaaacatccaaatctagaacactcttttccttctaaagtctttttttcgagtatgattcattctgtgattttagaagatatgtctaggggagtcttcccaacagggactggagacaacgtctccaaaactttttttaaggtctaatgttgtttgacttgtgttttattatttatagtttggaattaggtccataaataactattatatttagtatttgtaagtctatatattttttataatttgagtgtaattatacaagtgtgtaacaaaatatagtgaataattgaatgtaatccacattgggtgaactggctaaattctgtgtgttattttctttttctcttttatctttttattttttctcgattattatgtgattgtttagtatccaacatttatgaggtcatcattgcaattcccattatctcccagctccacactcctttccttcttataaatgaattttctagtctgaagtaagtaaaacattaaagttgagagaaaaagaaatgtttggagcaaagtttgtggcagttgtagttgtaaccctctggttatcacagtccaattttaattttgaagcttatggggatgcagtaggtgatgtgatcccaaccccaacttcttgtgagaattgtcaggttactccaccaccttctggttatccttcttatgaagctccaccaccaccatcacagccagctcctccatcttctggctactctatatatggtgctccaccaccaccatcaccacacaagtcaggccaatctaagtgtcctcctgctgcaggtgttcagtgttgtacccctcctgcaccttacacttatggttatggttatggacctccaaatccttacacctatgtgccttatggggaaggtcaaggccctgcttctatggttctgccaattatagcccccctcatcatgcttttttcctcctttatttttctagtctgaatttgccttctttttgttgtttatcgtcgtataatatcctgttgtcaatactcaatagttataaatgcttttgtaatatattcatcttgtgtagctccatgtggtatataccatatcctctccaagttcaatatccattgttatatatagttaaattccctttatgaataccctctttttggtatgaatatgatagcaagaaatcttttttcttagcaagtttgtggctaatttagtatttgttttgggggaagggaaggcaattttatgaagttttgttatttattttgatttttaagaaagggagatggagagaacaaattctctcccccatctacttttagcttttctccaaaatttaactccaattcattagttcaaaattaaagttattttaaggaaaagctgattggaaacacagagcatataataaaattctcttattctacgcaacatttttgtttgtactattctcacaatgattgttgtcattgtattacctttgtcctcgttactagtgacatttacaatctgtcactactagttactactactatttgttatatcatcaccattactttatcgctaccatttgcataaatggtagcatacaattatcaatattgttagcattattactacaactaccatcagataaaataacctaaataataattttttaataattaattatcaatttggattgtttgaaaaataattatacatctgggatagttggtcacagatggagcgatgcgtatataaactcggacgatcataacttttgactggtttgtccgattgaagcgtaatttgtgtcaaaacgctcgaaattgagagtagaagccctaggcaaatcccacaagaattatacacatgaaatttgcttctaaagaatgggaacatgctattaataattttaataaacattttttgatagaaaataacattaaaaaataacgtttaatatatctttcaaatggtttaacttttgatagaaatgtccggtcgaggtgtacgatatgttaaaacgctcgaaattaagagaggtaattaaaaaaataaaaaatagcatgcaattaactgaccaaataattaaaagaatagaaaacaagaaaatttttagatgttcgaaaattaaatcataattttgaggcacttagaagcattttttgggaatttttttgaccaaaaccccttcgaaaatttgtctagggcttctactctcaatttcgagcgttttgacacaaactatgtctcaattggacattccagtcaaaagttatgaccgtccgaagtttatatacgcatcgctccatctgtgcatgacacgtgtcgccctaaagtggaacacgcccaaaattggacgtgaccaccccctagtcacgcctagagctgggcgtgactggtcatgcccaattctgggcgtaaccaattaccccagatgtataattactttccaaacagtcccaaattgataattaattattaaaaaaatattatttatgttcttttcccaccatcatcattattacagttataattgcaatcaccattgtccccatcattattaacagatagtaacatatttgtcactattattaacactattactacaactatcattatttttactgcaataattgcaatcaccgttgtctccatcattattaacagagagtaacaacatatcaaattcggaaacgcggttaatccattgctctagcaaggtaaaacttttgggtggagaaaatctgcctaatgatcaaaacagctaactaacggttactgatccagattctagaaatggtttcagcctaatgctgcattccagtaattcaagcaggcatgtgatcatgtctaccaataggtaaacggcaaaaatgtgaagaggcattttaagatgaaatggttttgctttacagtcctcgtatcacaaaatttaggtaatttctttggcaacttcagagcccctgatacaaatctggcccagggcaagttgtcattctaagtatatgagaagaaataaataaaagcattacacatgagagagcctgtttttgaatgttatatgcagtgtatgattcttgaatccatgataccgcaacaaaatagcaattttttttagattgttcccgagtgacttatacagagtagttgataagggtccaacacctaagcattttctaagaacagcagacatgagtattgtaaagctaatcacagatactatagatgaggtcaagtaatagaacctctggaaacagctttgatgctgctgtttttttatcaacatcaacttggataggtagccggatacctatagatcccacttgagggacattttgataaataaggaaaggagtataacaacgaacaaatgaaatcccgattgctttttaaagtggatgctgagaccaaaggcaaaactattctaaaactaatcaatgcaacatttgagaacagaattggattggttggacacaaggcgaagctaacagatagcatattgacatcctgttatcctttgattttacactgaagttaccatggatatgtagtcatccttactataggttgtcaatcctcaggccctcctaaccttgggaagagacatggaactttacatccacatatcagagtttatgctccatgtaacacctcaagatgctaaatgaagattgattaaacatctccagaattatcctagtccaacaacctttaagcattgacgccatcttgtatctctcagaaaagcttgttgtatctattaaccaacttctgtcatacatatttcaagagtacttagtacttgcacattcaactgaggctcacactctatcacgactgctctacatgtgtttagaacttgtttggatatgcttctctaaaagcatttctaggagaaaaaaataagaaacaacaaatgaaaagagtttctccataaactaaaatgaactcttcgtagctaatttgtagatgtcctctcatcctttagaaaagctatttgagagaacttctacaaattagctaattgagagcacattttagctaatggagaagttcatctcattttcttatttttattttcttgtcttagaagtgcttttaaagaagctcacccaaacaagcctttaggatataaaggaaactagaaagacacgggggagagtaaaatctaaaattgtcacatagattatccttgatcaatcaaacatgctactaatcgagcagatgtgagaaagtaactaaacactttaagatctaatatagggatcttcctgcctcaatatttacttattttccctcgttcattaacaggccaaaataacaatttggttccaaagcttccagcaaaagaaaagaggaaaagattataacttcagcaaattacccctatatgtgtttcctacttccgctatgcataaccattatagaaaaacaccactctgaagtctgaactcttagaagaatagctcaaactaaaacctaacgacataagaactaagaagagaagataactgattgtaggattgttaaaacatacaagaaattaacatgtatgtgtggcacactacaactcaaaagccataaccattcagtaaatccagagagatataatattgaattcaattaacaatggagaaggggaagtttctcatcatcttacaataattcaatcctgatttagaaagacatactagaatccagcaatgtaagaaacaactaaaatccgttttgcagaaactttccaagatagttaactattaaggaagtgaaaatgcaaacttttccactacttaggctgaagttgctttgctatacaattaaattatctcaataacggattggtgattcaaagaacttgcctatcagctgcctcagcaacaatgggtaatctggggatttgacccagcaagcaagaagaagaaccataaatcaagcacaccaagaggaacaaaaacacagtgctatccaaagtcattatcaaatccaatcccaacccatccttgggattaaaccctctttcaaggaggtcagggaaaatcaagagcacatcaaggacaacggcttgcatagtgttgaacctcacatacttactgaaattggggtttctcaccacaacaaaataaagggtcaaaaacacaaggaatccattaaaagggaagctcttgaaaactcttattgcaggaaccaatggttgaacaatggcttgaacagggtagaactgtgtgattacatactttccgtactgtatgccatcaaagaaagggtaaaagtagcaaagtgctgaaattaaacggtcaggaacatcagcagagtcactgccattggatttggccactatgagggttctcagttggtggggttttctcaatttctttggaagaatgtttagagtgagaagagaggggggatgcagaaaagtggattgaagtggcttctgtgagaaggtaaatgctgcggggcagaggaaggaagaggaagccatgtttcaaacgaagattcgattttggatgctgtatgccaaatggggagagaatatgacgagggagaaagggcacgaggatagataacattacagtattacactctttcttctttcaacaaaaactaacaaaaaaaaatatcttattttcttaggtaaggaaagtttcatcaaaaaattatttttgttaaagattttattcaattattatctaacattcaatcttgattttaacacattaattacttatactttaattggttttggacataaaataattgaataacattaaatataaataatagaaaatggacaataaacctaaactttaaaataaacatgtattatttgttaaatagttttatatttttatatcttgtaagaatatatatttttcaaatatcattgattatttaaaaataataaataaattctctgaataaaaatatttttttatatgcaattattttaactactctgaaaatttcaacttttttttatattatataatgaacatacaactttttttaaaatgttgttgtgaataaattgaaataatctaagaataatagtttataaaatgacaaatgagaaaaaaaaaaagatatagatttaataatcaattctctaaacaaaatcaattattagagcagtaaaaaaatcagcaactagagttttacatgattccattgcgagatggtatagttgtgggctggcttggattgtatcaacaaacaagcctatatacaacagcttacattggatagccctgaccaaaacaaattaaaggcccaaagaaaaacaaagctccagatgaagtaaaagcacgagtccttcccccatcttttgtcagattttaatatgcatgtacagaaattgtaaattttttaacattattaattaatgaaaaatcattattcatataacttttaaaataattattataaaaatcaataaattttatggttctgtgcgttaaaatacaatgtcagtgcatactgcatatattatttattcattttgctataagatagaataaagaaatggtagtttatacagataacttcaaagaaactatcacggattatggattgaattttctctaacgttgaaatgatttaacatatatagataaatctctgtatcaaattactggttgtgagtggtatatatgttttttttgatgtatccactatccaggacatttgatggtttcaggtagagagcaccatgcatcgcttatattcttcgatgtgaatgtgtattggcagcacactgtcatcgcttatatcaatttcaatagttgctaatttcctataaaaaaaaaaaaattacctttatcaatgagtaatttgaggaattgaagtcagcttattcagtggcaggattcgaattaataatacttgtagaaatgtttaataataacaaattaaggtgacgagtttgatcaattgcttcatttctgatgcatgcaatgaacaaattatatactttcttcgtgtatattagtcaactttctgatttatatccaagtgagtattcatacctttaacacaaaatcttaaaacttaagttttgtggatcttttctcacttgtatgttaaagaacttttccattattatctaatatgagattttgacgtcacacttaaattctaacacaactaataaaaaatgtttcatcattcatatattcagctagaaaacacttccaatcacatgtatattcagctagaaaaaggaatatttgacaatgtgcatgggatggacgtaaataataataacaataaataatatacatgtgatggtacaaaaagaaagaaaagaaacactgtactttttaaactttgcaaagtgcccaatgaccaatgaaagtaataaaatccatacttatttcttggtgtaataataataattaaggttgtaaaaaaattataaataatataattttatgcattttaataaataaaaaattcttttaattccttaaaaaatgtcctaacgctatcgaaactcattagcatttttccaataataatgatagaataatttctttccctttctttcacttcacttcagcccccgaaattagtctctgagtcccagtggcaagcaagcactaaagagtaggagtgagtcatgcgttattatgattttaaaaaataataaaaggagcggcgaatagaggagcacgtcgatggtatgtatctgactatctgggtctacaaggcccaggcccaggcccaggcccaggcccaggcttacccataacaggaaaggcagcaggaggcacttgacgatggtggtaagcaggggagccgtatacgtgtccctgataatgatgataggcggcggaggcggagtccttagagtcgcgggcggcgacgctcttctcgccttccatctcgcggaagcgctggaggtatatcttgagggggtcgccgtagtcttcgaagccgagggtggtcatggcccagagaaggtcgtcgccgttgatggtcttgcgcttctccctctggcacttgtcggaggcctcgccggttatgaagctgatgaactccgacacgcattcctgcaccgtctccttcgcgtccttcgagatctttgcgttcgccggcaatgccttcttcatgatcctactcacgttcgcgatcggcaggaacctgtccagttcccgaggcgacaactccccgctgaagctccccccctcgtttcccgcgttctgcgccccgcccgactcgttgtccgactcagccatcttcttaacttaaccaatcaattcaacactctgctctgcttttctgagttcggttgacttcagagttcgtgaaaatttgagttaagaatggactgagcagggtccgttggatcggctgcgttaataagcctttatctgcttcacacgtggaaccttcttggccgttgtttgtcgataagcacggacaagtttcccaccatgggattggatgtcggattaatcatctggaccgttcctttcgtatctgctacatgctctcctctcttctctcgtttattctctttcttccgtctaatattttaattatttagcaactttgttgttttatgcccacacatcttaaatataaggttcaagattcactggtttttggataaatttgagttacttgttattaacagtttaaaattaatttcagtatgatataaataaatgaacaatatgctgtgaataaggtaaatgtttcgtgtttgtaaaatacacacggacgcacccccaacttatactttttatttgtttgttggttttagtagtactcgaaatcttagattaaaataacagcgctatctcacttcaacggcgggttgcggcatccaatcgctacttttttatcataatgcgacggtttccagtagcggccagtgatggccgatggcagcgttgcgggtgacaaatcttgcagcgctatcgcgccgctacttccatggaagctccaaatatacaaaagtagggattttattattctttagtgccaaaaaatcaatgatgtcttcttgatggatgaatatatagagtgtttctatagaagaatgctccaacactttagttactagcaattccagcaagtaatggtaaaggaagggagattatatgtgcatgaaaattttattttgtcatttataatagtgatctattttgctggtgttattgtttcagtatctccttaatcactttattaccactgtaacaagggtacaatagaatcagaggtacggtggtccttataacagtagaataattttgttatgacctttctttgattcacttgggctattcaaggcaacttagggtctaattaaacacgaggtttgagattctgatctacaattacctcaacttgagcctgatatatttatatgttaggtttgggtttttattattttggagactttcaatagctgtgtttgcatgtcaaacaagttgcgattacttcattcatgatcttacttctatgttggccccgattttgtttaaagttattattttagttcttaaaaatcttaaacatctattttttaattcttgtttttatgtagtgtagacaattaaatggtttttttaatactaaataatattttataattttaattcttatttttatatttttaagaattaaaatggtgatcttttaatgaagttaaataattttaaatatgaaaaacttaattaaacaatacttgttatgtcaaaatctaattttgaatataatgtattactcttgttatgaatcttaatgcttgagttttatttatgaaaaaaaaaggtgtgattagatcatttagatgtgtcggtgttggccataccacggtgagtcttttgagttttaaggcctccttgtccggtgtccacatcacaaccaaacgctatcctttacattaactaatgttatgtaaaggatgtaaaaacaagtgagtttattaatattttgttctaattttagtttttatttttattttaatattgcataacttttatatgtattatttataattttaaaatttacttatttatgtgtttaattcttatgatgtatatttcttagctagtcgtaattacaatattctctaaccatttatagaattagacttcattttatttttgggtaaatagtgaaattcatcctccaaagtatgatgtagtaaaaattgatttgatgaaagatgaaaaatataaatttagtccatccatattttcccaagtggaaaaaaaaaggtgtattttaaagttatactagcttataacactcctagaatctagattttctaccacaaaattcgcgttatggatgtattggccgttctcgtaactgatgttcaatggaacgtttgcgaagtagtgacagttataataatatttacactccatgtcaataatctcttttgttgaatttaattaagctactaacagaaaaatatttacaattagtgatttataactacaatctaagttgttaatttattttatattttttttataatttacattatcaatcaaattgtgatttcaaaacacaatacaagacaagcatctgccaagtttatttgaatttgagactttagtcacttgatcactactatgaaatcacctccaatcattgcaaagcatctggagaggagtatattaaacaacaccaaaaatctggaaaggagtattgttagtagtaaattgttttaaacatactttttatcgtttattaaaatttattaaaaacaatcaaattatttcaaacatgtctaagcacttggacaaaagctaacaaacaaaatttatcgtttattaacattaatagtgttttctttctatctctcttttgtattgcattaattttcacataaaatgaattcaatctctctacacctcttttttagttttaacataattcattacactctaacaaatatttaggatacattttttaactacaaatattttactatttttcatgcaatgaacttaacattaggggtgtacacacatcaatttgaattgggtttgacgaaattgattatctaatccaatcaaattaattttggtcaattttccaagaaaaaaatttaaaacacaaatcaacccatttgtaaacggtttggattgggttgagtcaacaaggtcaaaacatataaatttatctattattttttaaattttaatatttttataagctaaaatttttattaaatggaataccgaatacattacttataattattacgtgtagttaaatactagaagaaaagacaaggaatggaagaaaagacaaggagaggaattacattattgtcatcatcatcacataggtcaacataattatgttaaatatagtttaaaaattgaaacataataaacaagttcaataatcacactcatgaagcctaaaaatacaaaaactatagttgttatatcatagttttaaaattttaatattctcaaatagttaaatgagtagtgcagctgaaattttaactaaatctaaaatagttttaatacaaaattaaaaataaaatagatgttctacaatcaactgagaattaaaaccttaattttgtgagagtgattgagtgaacttgtgaaaactaagaaaagataaataatctcacttttagttattatgtatgatataaatagtaattgattttttttaaatttaaataataataataataataacttaatacaaattaataagccaaatcaactagttcatatattaaaatttgtaactaacccaaaattcaacaaattaaaatggattgagtgaatttgacccaaacacaaaaaatccaaactatttgaattcatttaagtcaattcaaatatgcatatatctaatattcataaacatccctacttagtattattcatcttcaactagaagaaagttaaacttcccaaatatttaaaagaaatgtttatctacttatatctttttttaagataaggatacccttaaatgacaacctcgtaccacaaactgaatcaacaatcggctcataacttgcattaacgatgaagaagaaaacgttcccataatggcctccaaagtgatagtaatagttaattgttggtcatctaacttgtggtacaataggtcaaacaagaggtgcagaacaatgagttatatatttgtaaaaaaaaaaaaaaaaaaaaaaaaacaatgagttatatattcacatcacccacccacccacggacactctcatgcaataatttgaatcatttggagacataggcttttcaagtaagcaaatgggtgacactagtttagttatagtcagtggtcacatacacatatggtgactttgcatatatgcatccactaataaacatcaattattaggggtgctaagtgggtcacccacccttgcatcattggtttaatttctattattgatgtgatgtccaaaccttgtgtttgtttcgttttatttgttcaactctttttcttacgcatattttttttagggatacaaaaaactagaatatatcaaattcaattgagttttaaatgttttagctcgtgtgaagtcttcattatacgtccatatgtaatgtagtattttaaaagtaactcgtgtcatactatagacataattcgactctaaatatatagagtctgaaccttcaaacagatacaacgttcctttttttcattaaaaaaatattaagttaatgaatttaaaattagttctaaagtcaacaaatctactataatggaaatttattatgggataatagtatataaaatgcatatccttttttctcaaataaaaataaataaaaaatagctattgcattttttttatataatttaacattgaatagtgttattttttttaagacgctcatttaaattagaaaggattttttccacacaatatttttcttaattacgtgataagtaagaaaataatctctcaaaattagataagtattagaaacaaagtcaaatgacacaagttaaaaaattaaatactgaagatatttaaaccccttcaacctgcgttgatattccgaaagaaagggatgtttggataagagattaaatgctcgattgcatcctttctgtgtcttcttttctatatgtatatatttcagtcaagactcgagtcctttctggtttttctttccagtgagtcctttatggttgactgctgcagagtaagctcggcccttattttatgggtcagagaattattaagcccatgtaaacaacgggctaataacccataagtcctcttaggaccacgccactagtttaattgtttatgcataaattcctttttaataaaaaatgctatggattcatatttgtaaagctagaaaaacaatagctaggaaaaaaatttgtaacgacccttctttgaaaaaataaactatcaaattgctcgtcaaaattacctatttctctactcttaaaagaaaatttcttttaaattataatcaccaattattaaaaatagtaattgtcacccatggtcctaaaacctttagttcaaattttaagatagtaaattgtagatttcccaaatataatatatttgtccaactacttattaaaatcgagagtagtttggtaaatgatttaaaaataacagtatttgttaaagcactgttatttactttatggcaaaaaaagcctatattttgcaacttgtaacatgcaaagtgcacagcctgagtcagcagatacacttggcacatgattgcatagtaaataaagtttcccggatatgagagggaatgggagatttgaagagaaaaggaaaagaggaaaataataagacaaattgatgacaagcactcacaaaagttcctttgtgtatctaaattagggaaggaaataggtttaacatgcatagagtcaatcactttggtctgacccgtttaattaaaaaaaaaagatttaagttttaaaaaaaattcatttagttaaataggttagacgtgagtttataaaaaaatctattaaatctgatagattagcatactaatttatttatatataataaaaattaatatatgtgtattatgcttttatatttaatattttaataagttaataattttatgtcaaataaaataaatatttgagataaaagactttaagtaaactaatagatcatactaaactttttaaaaaagacaaatcaaacttaaaaaaaaaaaaagaaaaaaagtcgttgatagattattagatcaaactagaccttaatttttaataataaatcagacttatttatataaaatctgatatatattttcactcctaatctatagtcattcaaacaaaacataatcatactgtgttttttaatgttacgaaacagataaaattaggagatttgattgagatttgaactaactcttaattaaaaaaaacacggcttaagattaaaacgccaagttaatagaagagaacaaaattttggtaaacatcaagaaggaaaatagctaatgactaaaacctcacctaaaataacagctcaagataacaattagtaataaaagattaatcactaagaacacaatgatctaatctgcaaaccaactccttctccaatctcaaatcttgatactttgtggatcccttggaaatatcaatctcaattaaattttcgtcctcattcatctcattaatttctgccaagagctctgtgagaccttgctgcttgaaaatggattctggcaagaactctgaaaagtggttgtttggaagcttgatttcaatcaagccatcctcctccccatcaacatcataatcaaagaccaagctatcagatatatcaagattttgatttctgttgcgatgaatctcaatactttcttcatccatggttgagctagcagtgctttcactatctgatggaagtgaagtatctgactgtggatcagcttgttgctcatacttccgagcacttagttcaaaacttgtatccatgatattgcttctttcacaatctaatggaaatgaggactctgagtgtacttcagcttgcctctcagaagtttcattttgttggatagtaacatctcccaatgaaggctgtaactccaaattgggttggttatcttggacaagattttcatgtagggacccttttttctttgccagtgtgacaagaaacaaggtagatagaagagcaatcagtagtgtaagaagggaaggagaggattcagaaactgaaaagaaaaaggaaattgaaaatagaaggacaagaactagaatgattggtaagaaactggcaaaataacaacacagattgtgacagatttgttgctttgttactttcaccatgatcattcactagaatgaacttgttgtgtcaaagccaaagcaaatgcaaagatccaactcacccaacaaagactgcaagaagtactgttgaaaaggagaagaagatcactgggaaagactacaaagaagtggctgaaaatttgttcaatctgtagttctgtacttcttttatgactttaaaatacagattgtgacacagcaaagatagagaaaaatttcaatgtgctacaaaggaatttgggacagtcaaaagagtcttttaagctataagttaatgctgataactttcagctcctaccctgcttcctattttgtaataaacagttgctaaaatgtcaaacagggagcaaaggagggaaaattatattttcaataagactcaaaagatcatggcttgaaccccaaagaaaaatatgctctttttcaccaaacctgacaagggtaacatttagtgacatctgatccttgaaagatcaagttcctttccactgctgagcaactctactagctaggaatccaactggcaagtgttaaccgaaccgtttcttctattttttttcctctgacacaaaaccttttattatttattatctgcatctgatcctcttggagatagcaaaggtgtttgttttccaacaatatttacaacctcaaagccttggatttgtccaatgcatgtgccagacatatctgacccctcccccacacatgccaagataccgaacccaacaaaacaaacttcatcaaaagagaactcaagaacaagaagggccttgcttctccctctattttactcacaaccaaacaaaaccacacagaaactcaatataccaaatcaggaaaaaacaacaaatttctcaaaacaacacttctttgtgggagttcttttgttgagacactttcctagtatgacatttccccccatcacatacatcaaagaaacgtttgacttcatattagttttttcctttcttttggtagcaatgaaaggattcgagtgtgatggcaggttgacaaaactttgctcctacaactacaattcctaattaacaaaggcacattaagtaatcaatattctgtaacaatgacccactttctattattgtttaggctcttgttgagccatgaagaagtaagtccttttctgcttcagcatgtcatgctcatgcaggctttaatggagtggaggccccattacagaagatgtctaaaactacatagttaggtattccccattactatatatcctgttccacactaggtaacatatcagctactaggacaatttagttacagttgccaattggtacaaggtttcaagagcttgcgtaaggaagacgtaggttcagcaacttatacagctagatgcctagattttgtttttaattagatcgatctaaacctactactactagtatttaatgaagaagactctttttatttatgtggctattttttatgaagcagaaaattaattaatacattttcttaattactattttatagtaagatggtgctaccgttagttttttttattcaataaatattaatttgttaattttattaaaaatatcgagatttgaaactatgattttttttttttttttttaacttcttgttcaaccttaaatctctttgtgctattgttagtgtgattatgtacgcgttacacatgctgttaagcgtgtcagtaatttcaaaaaaatcaataaaacttaggacaggtgttagaaatacaattttgtgatggataatgctcacacaattaatattatgacgtgtcagagtgtaataatgttgaaatattctgtcccataagtatatcaaatcttggtgaataattcgaagttttaaatggcgactgattaataatgtaccatatgcataggtgacagatgacaattactcaaggtgggtacatgcatatttctcatgtttaagcaaaaaattggtaagagacttcaattcatattatctttttattgatttctagaaaagcatttgcaattacatatcagaaacaaggtgaatgtccctgtcagtttttttacccttttttaccttcttgtattcaattattagccttaatcccctctcataatcatttgctcgtgcctacaaagaaatgatgttattatgagaaacgaaagagaacaaaagacaagaaaatcgtggaaacagaggccattcacaaaaagacatcgcatgactcaagcgctttctcgtgactttgattgtgtttcttggtggaaaatcttgttgattattatgcctactccttaatgattaatgttcttataaaagtctagcacttttcatcatttatttaataatattttgattttatgaaccttttatcaatattttgtgcaacatcatttgattaatgaaccaaacagaaatttagcaattgctaaaccgtgagattaaacttctttttatatgaaagttgggtgcaattttttttttttcttgggaaggccagaaaattttattgcaatgaaaaagaaccataaccatttgcacccaacagaaagccactcaaggtaaataatattatagaaactggattcgtgtagacatcatgcccatcagtccaaaatccatgtgcttaccatatttcatgtatccatcttccccccacaaccacaagcatgacctctcacgaatttgctgtgaatacaccatttatgtgaagtgttggatctattagttaatttagaattggtatatatatatccaatttgcacaagggtcagaatctgagtagtcaagaggaacaatataatctactacaactgtacaaaaacaaattaaatagaacctgtatgatgagtatgaatcagacacagatgcaaagagatgaaaggatccgagcccaacaatgttgtctccttaagacaatttgttccctccaattgatgccaaaggttgatgaacaagtgtctcccaggatagaacggatcaacgtctgaagattgatggcacttcaaatcaacagcccaaacgaacaaagctaatgcttgaggaaccacagagttatgtgatatggaaatgcactagtatctaagcgagaatatcagaaaagattaactatcaaaactctatcagtttttctgcttcttctttctgactgtctctgtgtctatttatagacaacaaacaaccctggtgaagagttgccggtaaaccatcgcgactcttggcgttgaatcatcgcgactcttggcgatgaaccatcgtaaccgttggttatcggaacggttgggagtagttattttttctaacctttcccaagagcggttaggagtagttattattttgaattgttaaccgcctcttattcataacccatggagtttaaataaaaactccaacaatcccccacatgaataagagatcaattcaacatgactaaatgcatatgaatatgtatgcaagtgtgattcctcggcgagaaacaattgcatcgagataggtaggggttacctttgaaccttctctagtgtaaacctatcgggtatactaggtcaatcggtggtcgtgatgccttgaaccgtcgacctttatggtgtataccgagacaataggagacacacaattgcttctctagcattgctcgtcctcattgttgtgtccattttggccgtggacaccttcctggttctgcaagtgttatagagaatcggcctttttaagttctcattgaagcggccctcacttcacactcacataggtgatttcttgtgatatacctccacatatatcatctgaacacatcagattaagaaaccattaaaagccgttatgcttaccctcatatacactgtattgtcataggaatgagtatgagtttaaaaactccacagtgtttaacagtcgatcaagacttagttgtctctttgaacctagttcgtgggatctccactcatcaaggtagagttaccgcgatgatcaacaattgataggccttaaacccattcctttcgacaaattttcaactagctctctaggaatccctttagttaatggatccgctatgttctctttagacctcatatagtctattgagatgattccattcgagagtagttgtctaacggtatcatgtctacgacgtatatgtctagactttccgttatacatgatgttcttagccctaccaatggcggcttggctatcacaatgtatgcctacagctggtactggttttggccaactaggaacatcttcaacaaaattacgaagccattctgcttcctcaccggctttatctaaagcgataaattctgcttccatagttgatcttgcaatgcaggtctgcttggacgatttccaagatacagcacccccaccaagggtgaacacatatccgcttgtagatttagtatcattagaaccggtgatccaatttgcatcacaatatccttcaataactgcaggatactgttcataatgcaaaccaaagttttgagtgtgctttaggtatcctaaaactcttatcatagctttccaatgatacatgtttggattactcgtaaagcgactcaacatgctcactgcataagcaatatcaggtctagtgcaattcataacatacataagactgcctaatacttgagcatattccttttgtgctttagctttgccagtatttttcaatagtcgaagactagagtctatgggattattcacaggagatatatttaaacttttgaattttttcaagaatttttgtaatatagtgagcctgtgatagagccaaacctcttgatgttctatggattttgatacccaaaataacatctgctctttccaaatctttcatgtcaaatttgctggcaagcaattgcttagtagctttaatcatttgattattactacccattatcaacatgtcgtctacataaagacagactatggcaaaccctttatcagtattttgaatgtagacacacttgtcacattcattaatactaaaaccatttgataacataactttatcaaactttgcatgccattgttttggagcttgctttaacccgtaaagggatttaattaagcgacaaactttccgttcttgtcctggaacagaaaacccttcaggttgttccaaatagatctcttcttctaagtctccatttaagaaagctgttttaacatccatttgatgtagttctaacccatacaacgctgctagcgcgactaacatcctaatggatgtaatccttgtaacaggtgaataggtatcgaagtagtcgagaccttcgcgttgcttatagcctttgactacaagcctagctttatatttatcaatagtgccatcttccttcatcttccttttgaagacccacttacttcctagaggcttagtgccaggaggaaggtctgtcaattcccatgtgtgatttgacaagatggatttaatttcactattgatagcctcttcccagaatggtgcttctggggacgttacagcttctttatacgtctgaggctcattttctaacaaatatgttagaaaatccggtccaaaggatgtagtggtcctttgcctcttactacgtctaggttcttcctctacaggattaacactagttgtagtgtcttgaagtctcacaacattatcattgtcattgccacttggttcatatatatcctcaaagaacctagcatcccttgattcaataatcgtattaacatgtatatctgagacatcggatttataaaccaaaaatcgactagcactactattaagtgcataaccaatgaatacacaatccacggttttaggttcgatcttcaaccttttgggtttaggaaccgcgaccttagccaagcacccccacactttcaagtatttcaaggatggttgctttcctttccatacttcgtatggtatgctctttgtcttcttgtgaggaactctattaataatatagtttgccgtcaaaatggcttccccccacaagttctgtggtaaaccggacgtgattaacatagcattcatcatttcttttaatgtccgatttttcctttctgcaatcccatttgattgcggtgtataaggagcagtcgtctgatgtataatcccagattctatacagaattcctcgaaggggccatcatattctccgccacgatcgctccttatagccttaattttcttgttaagttgattttcaacttcatttttatattgtctaaaagccacaagtgcttcatccttactattaagtaaataaacataacagtatctactgtaatcatcaatgaaagtaataaaatatttcttattacccctagatggtacatatttcatatcacatatatcagtatgtattaaatctaccaattcagttgatctatcaacagaagaaaaaggtaattttgaaaagtacagaaacactgattaatcacacagatcaaacagaaacactgattaatcacacagattaatcgttcaaaagtacagagagtagacaacagtatataatataaaaagatagaatatactgaacccagattcaatcaaattgtcttaagattgttggatctattagttaatttagaattggtatatatatatccaatttgcacaagggtcagaatctgagtagtcaagaggaacaatataatctactacaactgtacaaaaaacaaattaaatagaacctgtatgatgagtatgaatcagacacagatgcaaagagatgaaaggatccgagcccaacaatgttgtctccttaagacaatttgttccctccaattgatgccaaaggttgatgaacaattgtctcccaggatagaacggatcaacgtctgaagattgatggcacttcaaatcaacagcccaaacgaacaaagctaatgcttgaggaaccacagagttatgtgatatggaaatgcactagtatctaagcgagaatatcagaaaagattaactatcaaaactctatcagtttttctgcttcttctttctgactgtctctgtgtctatttatagacaacaaacaaccctggtgaagagttgccggtaaaccatcgcgactcttggcgttgaatcatcgcgactcttggcgatgaaccatcgtaaccgttggttatcggaacggttgggagtagttattttttctaacctttcccaagagcggttaggagtagttattattttgaattgttaaccgcctcttattcataacccatggagtttaaataaaaactccaacatgaagccaatctgcagaaagttgagtgcaattgatttcgagttgtaataccatataattaagataagtgtctaaattactctcaattataattttttacattcaaaatgtatgtcgtaataaaaataatttattactggtgcaaaataaagaggcctaagtactctacatatcactttataacattttaataaccttattcggagttgtcaaacataagatgattaaaggtggtaaaactcttcctaattaataagttttaacacatacattctttagattcatattaagagtataagttaaattaaaacaattcactcttaattagtttcgtactcactttatatataacacatagataattaaataatgatgaaatttaaaataaggatatattattatttattgtatatttgtattccaatttgtatttgattagaatagaatctatgaacaatacaaaaaaacaataaaattgaaatttatgtacattttccttaatatataagtaacaaagtaatatcaaatcacctattaatttaatacataaaattggcatttcttacacccctcccctcccaaagagttatatgatgaaacgaataaggttaaactaaaattttaatccttttatttttatttttattttattttaacttatgcattaaaagaactctgcatataaaatttcatgtttcaagtctccgtcaaagttttaccggtcttctttttaccatgtaagagtcaaaataaaaatgatattaattaatcttttatataaaaaagaaattaaaaaattaaaatatttttggaacaagaatcaaaattaaaatattaaaaataaatatctaatttaatatcattacaactttgacaaataaaatgaattaattcataaatattttttaaaaaatttaatgatatactttttataatgtttttttgaaagaaatttaattagatttgaatatcatattaaagttttaacaaggacattttttcatttaatactaaaatgttgatgcggaattaaaataataatatcatataaggacaacttttaaaaattacctaataaacaattgctaatctttatctcttataaactatcaattattctaccaataaaggaaaaaaaaaaaaatatactacagagaatcccacttgagaatcaaagtgacaaaactgcccttcaatctttaaacaattctgtccgaatcagtatgacatttaccagcgatcaaaccaaacaaacgtgcacagtgaaaccctatagttagggtttaattgtcctctcaatttccaccacaagaaagcatctttctctaatttgatttattttttgtgttttattctttcgagatttgtgtttgtgaaattttgctgctatctattcaatcgggctttatcgcccattcaaatccatggtcgtcagtttactatggatccctctcatcagattgaacaacaagaagacgacgagtggggtatgccatttttccttcaatttcgtctctttttttttcttctttctcttttgatctctggatgaccaaaccggaacagagaagggggaaattaggatcttttgtgttgtttttatttatttatttatttgtttctgcattagattgaattttgttgatttattgcatatatgaggatctcatttgattttgacaaggattggttattaattaattcactgctattgcttgagagttcgtcatgttatctggattttattttccggagatattgcttgtggcgctcggtgcttcacatccgtgtgtaaggcatattgttctagcttaatttgatatccagctgattcaattttaacactgtttgattttcatgtaaattagaggtatttagggtaggaatcataatgtcctagcatacagagaatttatcattgatataggtttgttattacatgttgacatgttgtttatgtctatacttatgcataaatatatttcagttttgcaatttattgtgctatatgttttgctatgaaaatgaaaagtctgtgactgtgttcggagttttttttactttctgactagggatagttgtttctttctatttagcaatgttgggatggcttctatggggacaaaaatgcttttgcttttgatgttgaatggttggacttttttttttgttgtagacactgatggatttgtgattccaagtttgggaattgaagactcagatcaaaataaacctcatgttcctgatgtagaatcttctaattctgcatcaaaggtcagctaaagaaaatttcctaatattagagactatataattttcaggttttagatgttgatactgacagggaagacaatgtatatgctaactatatttgtttgtgttctaggctaagaaggaagaaaacatctatttgggcccacatggagcgcctccttcactagcaaagcagcaagagctaatttcatctaaccggaagcaaaagttcaagcaaaagctgaaagaagctgacaagagaattagtgggatgggtagggagaataaagtggataacctgagggagcttgtgggtgtggggaaattaaatgtcaacaatgcaaaggaatctcccaaggattggttagatccacattgccaagaatctgagtttgagaggaggtaatgccctcttagtcacggtagattttgcttttttgagctattttattcttcgggattgtccacttaagcaccttttgttatacaatttgatctaatctatcgagacccaagtatgaggtcatgtacttgacaataaatttattaattagtgctttgataataaaggtattttgcctcatagtaaactgttcatttgtgggaattggagacttaccttgatctcaattgccaactaatcctgatcaaggaaaaatatcaaggagctaaggttcacctaccttattgactgttaacattgaaatctcatttaatgtaatatctattagttcaagatgttccaaatataagtcttttaaaacagaagttattgttattcattcaacaagaattaaacgatatcaacatcaatgacacatttaaatgacacatttaatgatacatgaatctaatgttagatacgaggagattgaaaaaaaataaaatatatatatatatatatatatatatatatatatatatagagattttgagatgaactattatgatataataagaattaaaggataaatgaacaataattacatgaaaattctttttgataaaattattaaattgagtgaacctcaattgtacaaattgtaattattactgattaaaaaattatacaattttcaataaagagaaactaaattatgcactcaatgcacatttacaatatttgttaaaaaaaatgtacatttacaatatcattcataactgttatgtatccaatgcaagtttttatattaaccattaaactcaaatttgaatgtcatgtcatcacaatatatattttaattgtccaacttcaataatttatgcattttccacgctattaaactttttttcaattcattatatgattgtattggacacttgaattattggtttgtattcgaagatttttgccgtgcactatttccagcttcattaatttcaaaacgaagaccgcaggcctaattcatccccgaactgaaatagttagttcgaattgaatatatttagtttacaacaatttggtcatcttggcctagttaataaaccaataaaccatgaagactaacaaagaatgagccgtgtaatacccccaaaacattgtattaataagtgtaatatcttctatatcaataactacaacaccctcagttctaacttctaggtgtccactctcatccaagactaagcactcaagcatatagcagctaaggcagtggcattaaattttatactctgaagaaaccttctcacttgatgcccaagaactccaaaccagttgctttctgtgtcaaaccaagctgagacaagtattcagcatcatagaatttgctcaaatgtctcattccactgtcgcagagaatggttacaattgtgtgaccagtgccaattgcttgcgctactctaactgctccaacacagttcattgcagaagaactcccaaggaagagaccatcgttcttcaaaagaaacctgatacatcaaaaacaacatatcactttatttcatcatttcttcaagtttgacagaaaagaacaaaaaaccgctaaaaataagaaaagtaggatggtttacaaaagagtaagtaacaacctagacatttcaacagcttccctatcggtgcctctaaaggccccatcaagttttgccattgcaaaattccttgttatcctgttaattccaattccttctggtatagtgtcaaatggattcttgagtcttcttccttctgcctcctctttggtgtacatcactcccctagttaccttcttaaacaaacaagagccaggaggatctacgaggaagcacttgatgtttggattcttttcctgttgaatatagaaccagaaataactcacataactttcacactcaaaacgacaacatctacaacctggaggaaggggggatgtggtgaacctgaagaaacttagaaacaccagccagagtaccaccggtacccgctgatgcaacaaatgcatctaactttccattggtctgctcccaaatatcaggccctgtaccctcataatggaccctgaagttcgctaggttctcaaactgatcagcaaaaaagccaccttgacaatcttcaaaacagagagctgtaattgcatccattagattcataaccatttattttctcggtgtcctccttgccattcaattgttatgaatttctacgcttcaatgcaaactcatttgcttcagatgctggtcttcttgcaatattgacaaaatggtctttgtgggtgatggacaccggtctcactctttcaacagttgccccaagggcttcaagtatttgagactgaaggttgattcatgcaacacaatcatcaattgtacacaaaatcttagaggtttatcgctagatttcataacagaatttacttgattacattacaatcattataaaataccttctcaatggcagcatcatctggtataaccacgtgggtcctgcacccataggcaggagcaacggtggcaatgctaatggcagtgcttccagcagtggcggagccacattgaaaccagcggggccatgacactacctaaaaaataaaatttggcactacctaaaagtaaaagctggctccgccactggcttccagcactcccttcagtgattattccacctggacgtagctggccagattctagagcctgcgcaatcaatcatagggacaatcttaaggctgatattgttatgacttaagcataagagggaagtccaactcaaaagactagttcatcaggttggagagcctcatgacttaaatatcacattaaacttcttattctacttgatgtagaactcataatttaaatcatgtgtgttaatatgttatcaagcagattccagatatcttcatatcatgcagcaagttgtgcatatcatgtaagtatttaagtaaacatagcatatgcttaggtgaaaataacataattgaggcaattatatatagaaggattgtataggtggtacatgtatatgtatatcagattgagaatgaatgaaaaattgatattccatccaaaagaaagcaattctgataattgtatgaaaaacagtgaataatagaagatgcgaatggttgaaataaatagatagagagcagttgtttaacctcatgaataatttgaacagcaacgcggtctttgacgctacctccggggtttaagaactcgcacttgcctagaatctgaagagaaataaaaataggttgagagtggaattggtaaagagaatggaagcgaagtgatcatagagaacataaatacttggcaaccagtggcggcggagaggctgttgatccgagtcaaaggcgtgttgcctatggcgtccaccagtcccttcttcttcttcttccttgattcgttcttcttcttcttctatcgaagggagaactatttttatagcatttttttcaaatttaaaatgttgttctctctttcttcttcttcttcttcttaccagcaaaaaatattagcaatatatagtccgaaaataataaatgatcatgagcaactagggcaacacctagcacgtgcagacctaagctcaaggaatgagaaaaaggtaacaacaagccaatgttcaaatctactatcacaccgccaaagtcatgactcaagactcgtgtgattctttcagtcaaacttttcttcatcaactaaagacatggaaatatagaggagtgcaatgcaaactgtgcaagcgtgtgagggacacaccaattgtagacagatgtactacttaggaagagtcactttcaattcataagatcataaactcatcactttttgaatcatcatttcaatgtgtttggataagatacataattgattttgggaacaagaactgtgtgtgtaatcgtgaattttgagaagcaactatgtgttgctcatggtcacaattttttttttcattgtgccaccactccaaatacgcatacaatgtaattgacagattttcataatcgattatggaattaaaaatcatggtgtgaccgtgaattttgagaaacaactatgtgtggctcgaacttcaccgtgggattggtcacaattttttttatcatgctgccactctagacacacactcaatgtaatagactaattttcacgtttgagtttgatatgtagctaaatttaaattaatcgaataatctctttttttatccaacttatctcaaataaaaatggaattaaataatctcattgcattttatgggtatacttaatatttgcaattaataatcttaaagtatattaatgattgtattgatcaatgagaatgtttaaccttacttgaagtgaattagacaatctctttctttaatttcattattctcagtaaaattaaaatgtataattttcgacttctgcccaggttcaacttataaaaaaatgaagtgtgtaaaattagtgtgtgcgagcattattaattttaagtaaaaactctagggaacaaaacggttcacacgtgaaccgaaagaaaaatgctaatatattagtatggttttggggggatcatgaactaatttatttaaatttatttattgaaataaatgtttattttaataaaataattttttaatgtgttcgtctaaattgtttatgtttaaaaaaaatattttatttattttaataaataaatacttgataagttttgtttaaattacaaatttcaaataagtgattatttaaggaatgggatttgttttttaaaataagaaaaaacaatttttgttcagacaaacatactaaaaaaataaaaattacttattttaacaaataaatttaaataaactcattgaatatttgtttcttaatttttaaaataaattcacccaaaatgatgattaggggagtgaaaaatgagtgtgttcccttgagtccaaatccaaaaaacgagcagaagaaacagttgttgtgtctgaaagaatctctgcacagaaaacccaaccctgagtcacactcacttgctccacaccacatggccatggagatcccagagaagttggtaaagttcagatactattttctcggggcactgctcttctctcttatactgatggccccaagattcatgaccctcttcgcctatttctggccactcttcctctccacagctctagtccttgcctttctcttcttctttgctaagacttctttacactaatcctttcatttaactctacggggctgtaatctaacactaattatatttacttcttctcatgctaagttaagtcatgtgaagtttcaacagatcaaagtcgctatctttatttcaaaagtattaatttaaggcgatagttaaatatcagtgaaattaatgagtttagtctacaatatcatgaatcaaaattttaatctcgtagaaagaggtgtgtagtgtacatgtggtgtcggcctcaagcatgattgtattagtagaaaactagtgaaaaaatgtcggttcatttaattaatgtttaaaaagttaaattaatcgcaacgagaatgatggtttttattcttaaaaatatactaatgatacgagggattttttgaatatttcaagcccaaaacagaattttactcgattttaatttcttataattatcactatcattggcaagctggcagctttcttttgtgttttgttaaggataactataactatgtcttgacgggccattttaacggttgagttgtgtactaattaatgttgttataactctcttagtttttccttaaaattattttagctaaaatatgaactgaaaaatggagttgcgactgtggcagagtctttttgagtgatggcagtgtttgagtgagggtgtgatcgtgaatgatgagatatgctcatatgccgtacatgttcattgacattgttcatgaaaaaaatcaccatcataatagtcaaagtttagcatctgtttagaaatataatttgcacttttcaaagttgaaccaaacaccaaaatttttaagtttgatcagttgctaatttcttttaaaatttaaatagattttggttgtaaattattttgaatagtattaagtaagttaatctaaataaagtgtattctttaatggtgggaatataataatcgttctcgaaagttatggaaccgtcgtagtcgacaatgcaccatgtgccatccatattagctgctgaatgttcatttgtcaattactagccaggggacagaattcagatgccctgaaaaagtaatattacggggagaaaaaaatataatactattaattaattaattctaaagtaaatactacaatttttaatccaaaaattgttattttaatgtggtattatctttgcatattgtgaatcatcttgttttgaagggagctaccttctgctatccactccactagtatatttggtaggacactaattaatatttgtttattttataatagatactcttttcgcttgagagattaatataagttatactttaattcttttgcatataaataaaccttttcaaattgacgaataaatatgaaagtgtgagcctataattaatcattattgttgatagttattattttttactggtgttttggtcagaaaaaaaaatataaatgtgtgtttcaatgatttttttacaacttaattcaacaattaatttgtaaaatctaaatattatttaatattttagaaaataaagtaaagtcttaaacacttattattaacttaaattttttatctaaaatatttatctcattttataagatcacaaaataaaatgtagatgtttaaaaaaggctattaatgatgttgagaatcgccataagaaaaaataatctaaaatgttcatttatattaaaactcatatataacatatgtttatcttttaatgaagatgtatgtatattttttttaaaaatgaaaaaatatgtaatttaaatatcgaacgtggaaagcgcaatttactctttttagtaataatctgttaatcttacactgaaataacccggtaagaatattttaaaatatttaactttacttaaagcgagagatgctgactcacttggagggagcaatgatattcatgcaaacaaaagagtttttgccaagctgctaatgtcagacaccaaccaaatttgatatgataagattgaattgaaacaaaaccaaatttattagtattttatgtacgaattgtgttgaatctatttatagctatttgtctttgcaagtgaatcggattatatgtctttacagatgggtataatcgtgtaaaagtgatgcataactgatagcataggagacaatgggtacgcaaatgccattatttttaagtttgaaaaattcgtcggtgatgttattggtggaccaatatcattttttgaaattgactgcagtttgcaaacaacaaacaagccaggaacctttctgatcagatcatatataaagggttaaaaaaccagtagtagtagataacaactggacaactttaacccatgcttaattttttataataatttgaaaagttgttttttagaaaataaaagtcttctaccacataagattctgaaaaaaaatctctcgtcttttttattattattgacgaaaaaagcctttttggatataaaactttaaacaattcaaacaattcttaaaggaaatttaaaaacatttttgggggtaaaattgatccaaactttggctgatttttaaaaaaaatacaaattaaataaatatttagcaaaagggggcgaattcaaaattatttaggaaaatggggtaatgcaacacgcccagctggggcgtgtataccacccttgtaacgcctctctttgctctctcgtgcttgattgattttagatgagatttcatttctgctttgtatttgaatggttttagttgtaaatttttcacggaaaatccttttcttcttgctctgatttttcctatcgtttataacatagacgattttccttcaccgcgatttatttaaatacagtttatcaatacaaattagaatataaaacagtccatgttacatgtccataaataaacggtccaaatacatatcataagttacaaaataaaaattacaacatctttacttcatcttcaatttaacatccatacacatcttcaatccaacatccatgctcagctactattgttcatctgctcgcccaacagattgggatcatcacaggtgtcaaccaccgacacaaaatagggtaagcatatgataaacatagtttgaataaaacatatatagacacagatggagaaaaccttaattagaaaaaccacataacttatacagtatacagaacaacatacatagatccatcatgagatgtatgagatgcatgctcatctttttatatgatgcatgactgagatcccagcttatcataaaatggtaccataatcaacatagtttcacccactctagtgaaacttccctccactctgaggggtcatagtcaaaaatagtttcacccactctagtgaaacctccctccactctgaggggttagagggtaccatagtttcacccactctagtgaaacctccctccactctgaggggtcaaatacagatgaactatgccatgacttgtttttatttcttatttacttttcaccatttattttatttctcaaaatctcagatcagatagttccacccactctagtggaacacatcacaaagctcaacatctttgaccattcagagcatatacttttaaacaacaaatcatcatatcaagctttacataacagccatatttcaacttcataaattcctcacagataaatcatagtttacatggaaaattccatagaaacactcagcaacacatgggaaacactcagcaacacatgaaataatacataactttcattaaagcaaccaaccacacaaatataattcaactcaacaacaaggattcaagccaacattattaaacatattttgttcattgtgacatattatcaaacacatagtgtgcaagctttaaatcataaaattctgtaaagaaaactatttaaatcttaaatttcctaaaattcaatataattctagaataacatggttccaacataattcctagcataaactagacatatttcaagaattttcaaaacacttttaatggaacttataaattttagtagaacataactactttaattttagtaaaatatttgtttttcttctaaaatacctataatggactcattcattaagttaagctctaattatttatatatcaatcattctttaacctaaaaccaagtcatttatccaagtaatcatgttcctagcaatctttatttctttgagacatttcatcaaacacttagaatacaagacttaatcaaatgaagcaaggaataatattcaaactaagctatcataaactcccccatacctttgcttttccttgccttagaattggacagccctttgtttccttatttgaatttgaagaacccttgctcttagaatcccttggcttttacgtgaggtattaaaggtgaaaggctttagttttgtttttggtaaagggtgaagtagaaaaaatggaatggaaggctttttagagtgattttgcacgtcctagctccctcttggagctgcccattttcggttccactccctttatatagtggtcttgctacaaaaatcatcttaagtcataacttttgatcgggacgtccgattgagacgaaaccggtggccacgcgctcgaaatcgagaggaagagccgctggcaagttcccaaaggggacttgcccaaaaaagtttcccaaacgaggcctctaagtgcctcaaatttgcgatttagtcttcggagccctaaaaaaaatttctgttctctggtattttgtctatccaatcagtgaattgcaatccattctttgtttatctaattacttctcttaatttcgaacgttttgacataaaatacgtcttcatcgaatatttctacgagaaattacgtctgttcaaagttatatacaccgtcgaatctacactacaattttggattatttatgcatttgttaaaccaatgtggattaattaactgttggatttggttaattgtttagggtttagggcattgggttaatgattaactgttggattaggttaatggttttagggcattgggttaattgtttagggtttagggctaaggcgtagtgtgtttggataactgcatagtgttgatggttttagtattaggggtttagggctttgggttaatgattaattgttgatgttggttaaggggttgggttttacatagtagtccttgtcatagcgtgatttgattccgcaagagccatggccacaagggttactctgagagtagtttgcgagaattaaagggttactctgacgaccatgagcatgagctgatgaagaaggtgaatgggagaaagacatgatcacacatcttctttcttggtctgttttgcatcttctctgtgtatatgatgatggacttggcacaagtggaaataatgtacgtcaaggttcttgcttttggaatgttttagtattaatagaagtgtactatgaatatcagagggctgatgttacatcttgtaaatcaaatttaaaatttgagctgtctaaacgacacttttgaacagacgtaatttctcataaaaatatccgatgaagacgtattttatgtcaaaactttcgaaattaagagaagtaattagataaacaaagaatggattgcaattcactgattggatagacaaaataccagagaacataaattttttttagggctccgaagactaaatcgcaaatttgaggcacttagaggcctcgtttgggaaaaatttttgggcaagtcccctttgggaacttgccagcggctcttcctctcgatttcgagcgcgtggccaccggtttcgtctcaatcggacgtcccgatcaaaagttatcgccttccgtaatatacgaaaaaaccgcgaaaatcctaagtccccttttttgcctgccacgtggcgccatgggagcaaacacgccccatctgggcgtgtttaaacacgccccagctggacgtgttgcattactccattttcctaaataattttgaattcgcccccttttgctaaatatttatttaatttgtattttttttaaaaatcagcctccaaactttacttctataattttgtgcactattaatagttgctcaaccatgaataatagcacaatttttcatctgttactcgggactaagtattaacctcataaagctttcgtaaataaaacgtttaaagccatattttttatttttggattattgtgttatttgtatgaaatatttatttattgggccatctctaataacgtgatattgataattaattatacgaaagtgatttgtcaaaaaacaaataaaatgtcttttgttttcaaaaaaaatttaaagtataaaataattgacaaaagagaaaacagagagaaaaggagcaataaaaaaaaatctttattttttgttcatgtaatgatgataagattggacttgtatttatattaacaaaaattgaagaaataataaaattttgttcatgacctagttttgctggcacaatccaaatgcattgatgcaacacattctcaattttttttttttatgtgtcaacacccacccaaaaaaattacatgtaataacttgggttaaatgtgttgttgatgttgatgttgttgaacctccaaatccgtgccccgagctcattctacttgatcgaagaaaaagtgtaaaccaaggaggaggaaagtgtgttttgaattgaatgttccaagttgatctatgtatattaagctgtaaaatacaaaagactctgaactgaagtgtaaactgttaagcttatatacttacatgatatgatatgtataagaagctcctgatcaagtagtcaataattcgatagcatgagactgaccaataagcgccagtccgttcaagaaatttcagattttccatcctcatcaaagctctggtgtggtgtgcattacgtgatcaaagtggaaaataagaacactctgcaccaacttggtgcaatgtaatgtgttagtctaagatgactgagcaagagttatatcagaaattgatagtgtgccagaatcatcaacatcaagctgtttaaactcctgcatcacaagtgatatatcttcttgactaatcttccccatctctttgagcttataaataacgaattccgcagccctatgagaaacaaaacaaaagatataaaaatgaatgaagacatgttttataattgatagtataacaatatatatgactttgaaagaatgctcaactaacccaacagtcccatcctcatcaagatctgcagcctccaaatctaaattggtcactttccttgtaagtacccacttgacaagttccttttgtctgatttcagtgtttagctcagcaatgtagaggaaaagctgagctaaagtaatagtacctgtcaatatccaaaacacagcaaatgttcttcctgcttcagttgagaaactttgatccccataacccagggttgtaattgtagaacaaacacagtagaatgcatcaataacatccaatttctcaaccgtgaccaaaaaaattgtgcccgcgatgatgagaatcaaaagaaggaaaaagactagaaataatttgtatcttgttttattggtctcaacctcccttaaaatttcagttgaaccaactttttggtgcttgcgcatggctttaactagcaaaaattcctgtttctcaactaagtagtctgctgctttgcttacaattagtccaatcaatgccatcccagagaaaacaaaagcacatgcaagtagttttgtaaggtggctatttggcacaaggtctccatatccaacagtggtcattgtcacaattgtaaagtacaaagcatcaagaattccatctgttttctgccccttaatctggttcctgacaaggtagaagattaaagcacctacacctaagtagactgcaagatagatagccactcttttaaagcttggatgtaaattctgaaatatggacgcactatggggaattgattcattgccatttgtctcagtaggaacaatttctgcttgaggagcacttctaaagcgggggagccttctcttgtttagctgctgtttagtcttttgagtcgcataaagtgataccggcagcaagggctcctttacaccattgttggccatgcagaggaatttagaaaacaaggatctgcaatataggacctgattcaattgcaaaacagttcaaactagcaacatcagtcaaataagaaagggatgtaaatgaacatccataagccattgttagacttttaagtatttaaatgatgaagcatgaaacataaattcatccaaagagctttcacaaaaaaataaaccagtatgctcaaatatatactataataataggtgccagagatcaatccaagttctactttgagcttaccaccacaaatgcaaaatgaaatcatttggatcatcacttacaactgatacgagccatatggatctcctaaattgcgtgccttcatttaaagaaaaggcagaaaatgcatccatttcttcggagctagtgactttgtaagcaaaataactaataggccataaaagtagcataatagcattgaaatacaatgaatttgcccattatgctctacatgccaaaaaaataataatcatagagcaaacgcaactagtgaactaggacttcctatttacctctcaatttcttaacctcaaattcaaatccattcaaattctaatgaaacttacatcagcctcatcatattgaacattcccagtttagttctcattacaaaaaaaaaatagaataaaagggccattagtcatctcacagaatttcaccatcacaagtattttcctctattcatgggcaatcctccaagacaaaaaagttcccataaacagtgacccaaaattacacaaacaagtcggggtgtatcccttcaaaatcgtaacttgcaagagccatccgaaagaaatgaaatatggttgaagatcacaatctaaaagttaaaaaaaaaaaaaaaaaacctccttgactaagacttaagacaataatgatgcattcaatttgggagaaactaaattaataaagtggatcagagttgaggacaacagttaatacttaaaggttgatcatgtgaaagacttatccaactgcagttcatgtcaaggagcattagatttccagaaatagcaacagtgctacacaagttcaatctaacacttttttgtagagaataaatctgcaaaatttaaaggtcatggatgactaatcaatagcaagtgaacaggcaaaagagaattaaaacgaaacaataagcagtggaaattccaatcaattatgaatcgagctagtaagagaaagacatgtgttgaactaagaagccaagaggaaaacaaacccatcacaataacaacaaatgtaattcgtaattgcgaggaaagttctaacctttgaagtggtttgttgttgttgctgaaggagatgagatttgagtatggcgaaggcttctgaaagcttgtgattcaatgcaagtggatcccatatgatctagcttctccataattaatcatgaatcaattccgcgttaaagagattttgtttatttaacataaaaacaaataaattatttgaaaaggacaaaaattaagttcccatatatgcgccccacttggcagttgttctttcgagtttcaaccatattttgacttcttttttaaggcttgttgtcggaaaagaaaaaggacatggtttcccatttattcatggatgactgccgactataaattgtttaattatattttatttaacagtaagattttattaaatgatatttattttaagaatttaataataaaatttattaaaatgagacaaaaggaacctacttagataagacatactaaaagatttattaaaataagtataaataaataaaaagccactaaatactctgaactaataacatgttaataaaaaaaattataaattataatcttttcaaagtaatatttacatttgaaagatatatatttatagtcttttcaaaattttgatgataatcatgttactaatttagattttacaattgcaactaatcagcctaatgtatatattttttaaacatattttaaagaataccaacttaagactaagaagttttaggactcgttttaaatggttattcagtgttgtgttcacatatgtttgcaattttctataattaattaattatgattaaaagattgttgaatagttcgtcaaatgaattgtaattgtatttttaatcaatatttttatattcatcatttttataatcagttaaaatacagctaatcgatacaaatatatgcacatatagagcacctctatcacaaagtgttaaatagaaataactctgtcaacaacccattttactagatttgaccatttgagagcaaccataggatgagagagaaaatgtttgagttgctttggtcccttggatagcaattgttctctacaaaaaagtgaggcccaaaatttttattttgaataattagagatacacaatatagaagagtaaggtatttcaggacatggacttggataatggataatgtctagcccctactctatccaatctctattcatttctacatggtgggtctttctttctccatttttttttcgtgtttttccttttgattttttgttttgttgcaaaaacaatagccaacagggcataagatgatctaatttgggtatattgtgagatacattaaaaaattggttaacttttttatttttaaagttaaaaagataatgatatcaaagaaaaatatgaacagctataaaatattagtattagatacagtaattaataacccaagtcccaagtgagttgcttaaatataaatgttgtttcatacaaagcaaaataaagcaatgtatgtaaactatgagaaaatagccaattaccaagtgtcaatgtgagtaattttttaaagtatcattggggccaaattaatgttagagggtattttatttttaccggaataaattttaaatttttatctaaaagggataaatcataataatttattactgacttctgagttttaaatcctacactatttactatttttattttttgttttttaaactgaagtggacgtaacttcgtaagaggctaggaagaaattggcggtaaagttgagcaattttttttatgcaaaattaaaaccttgatccaaaacaacttaacctgttcaatcaaatattcatatattaaaatgacatactgatttttgtttcaatgcagatcagccagtggttgaccaagcaattaatgatatatgtattcttatgcaatgcaatcaccgtaaccttaatacggtagtttttcgcactatcgtttttgccatttttcttttggtatggctcttggtggattttggtgaataaaacttctatctgagtttctgatatgcttgtttttctattatttatttgtttgaaacagaaagttatcaatgtttaaggtttaaatgtttgggatgcttatatttcttttattttcattttttgtaggtttctgcagggaacgggtacaaaatgagatcaccctcaatcttggaaaaattcactttgttgtcagaattttcttaataataataacagtagtagttttattttcacatataatactgtttcatgaatgtgtgtacatttttgtataaaatacaatctcgccactggcgtgtctaattttttttatgaagttcaaaagacacgtatttttatgagatcccctgcttttattcatattataattataatttatgatagtgagaaaatatgattccattaaacgtgcattattaataaggctggcatatgtggcattctgtcatcaaaattctcctctactgctgcagtagtaattattaattaattttctcaaagctgatagttttgccttttactgagtttttcatattgtaatgatgtgtgctaatgtgtttaactggcaagtggtaagacttatggatcaagtttgtttctgctgtaggttaattatgggctggataagattcactgaaggagaaaggatatttgattgcataagttctcccaacactgtaagaactaagaactgatcttaatgtagtaattatttttaccatttaaattatatgcaggcatttggcttttctgcaggcccaccatgttcctgttcacgttgaagaagttcaaggtatcctattttctgggtgaaaatactgcaatcgtttagtttccttcttataattttatttggtacttcatattaacttaaaatgcaaagtgattcgaaatggagagaaacgttgcttaaccttgtgcatagatatcattagtgttgctcaatacatattagttgtggagaaagaatcaggtaagcaaatgcttttttgttttggagaaaataagaggaaaaaaagtacaagattcttccccaacttacttcctattgaaaagaccgtccatgttgaacttcactttcagttttccaaagactagcaaacgaccaattctgcaatgcaaatcgctgtattgtcatcactgtaagcaatcttctgaagacattagtttcgtttgcaacaatgtttctttgtttgaattctatctttatacagggaagaggctacccggatattcctacaagaaggtgcgaacttttgttttcatttacttgccagcttgccttttcatattgcattgcgaatgtgtctgtttgtatcctaacaggtttttgcggcttctggttgagaatttgcgtctacctgcttattgtttggtagattgtgatccctatggctttgacatcttgaccacttacagattcggtacaatggttagtatttataagtttattaattaagatatacatcaacatgtatatcattatagggatctgaatataaaatgtacaggatcattgagtcacttgaatctctgtaatggctgagttaaagttcatatcctgcctgactaatctattccccacgattatgttagcaaatggcgtatgacacgaaacatcttcgtgtcccagagatacactggcttggagcttttccttctgattctgagagatattttgttccaaatcagtgtctccttcccttgactgctgaaggtaaataaggatattacttgtaatgcgtcagatcgacctagttacatatctgatcttataaataccgtggtctcaacattccttctagacaaaagaaaagttgaagccatgttacttagatgctaccttcaaagggaggtaccacaatggaggtattgttcatatacattccaaaacatttgtctttttcttcaactgtgtatcttattgtttgttatgaaggttggagctacgtacagttgatactgcaaaaaggagtaaagtttgagattgaagctttatctgtgcacgcattttcattcttgtgagaggcttacataccaatgaaaattgaatgtaaattgataatgtagcatgttggacatctatgtgtcaagctctgtaccagcaactggactagggcataatcagtacatgccatttgttacgcattctggaagattaaacgatttcttgctgactcgcgtcccacacaaagttattactcgtgtctttgttttgtgttttcgaaattccgcttgttttgcaaatggtaagtttagttgtccgtgggggaatgggcttattggcatgtcggggtagaaatgggtctgtctaggatctttgaggcaaatttgtctacccaatttaaaggttttatgaacatcgaacagggttttatgttataaaaaagagagggttttataagcaatatggaacgtaatggtcttcggcatttatttgctatgatttggggttcatgccaaaattaaagtgaatcctataataattatgtactcataatgttatccttttctcacgggttgctcataatatcatctataaacttattaataattttctttcattttttttgtataataaatttatacaattttgtgtataaaaaaaggaaagatataaagaagagaacaagaagggtggaataagataattaatgtaatagaaatagagagaaaaaagtgttaccaaaaaatgttatacaaatagtatcctcttattaaaatacgtacaaaagttgtggatgcacgtaagtgtgcaacacaagttagaaaaataaatcctattaagttttccgagatatacttaagttggccttttaacatgctttgttagacttaacatcacatatgtagagtctaccgatgctagaatttagaacatctcagaaaacactagtagttactttcaagagtcccccaaaagatgtcgtgtacaccacgtgtgcactccacttagatttctattcatgtatttgctttcaagcgcattattgacataaaatctgtgatgtaaatcaattgcaagcatacacctcccagttctcattctcttcatgagattaataactctattttcaaggggctaagccaccgaattaaaagaccccacttcattattttgaatatatatagaaatgcattattggtatcgaagggacaatcatatctactgtcatcatcaaggtgatttatgaacacaacttcatatgtttagttttacacatcaaaagcgacttcttctaagccaactaatcaataattttatctgtgagaagcacccttgccacatgatatattagcgctcacttggacgctcatcttccctttttttatgtaacaatatacatgcacttttccatattcttcatcttggatttgctttgtttgtattgtattaattattgccttatttatgcatgcatgaatcggtactttgtaggacacaagaatagtagtttttatctagaaggaagatatctttagttagactttactactattatgtagtttttgtctcgtgagagttagtcttagtcccaccaagtttggcagggtctttccagatctcacccaccttgatatccgctctacagagagaaatatcaaacaaaaaacctttcactttcgagactgacttcactttggtagggaggatccacttgggacttagcttcatttgatcaaaatccatttaaggcagtgaaaatgaaaggcccatagttttgtgtgccttatcagtgtaatgacatttatgaatttttggccatatgtaccatagcatgtaattgacaaacccttgtgttgctttcagaaataaaaaaacaaaactctctctattcttatgctgttatactaacttactgtagttgtttcaagtctctaagttgtactattcccatataccatgcgttgtccttgttgtctttatacatgaatagatattagcaacttgatattgagcacagaagagtaatccctcaggttttaggccgtctaggaccatatttctcctggtcctggcacagatatcaatatgggatggacaacagagaatatcccagagctgtaacatggtctaatgggtttgactttgagatcgaagggtccagaaaatggtagtgctgagttaaactttcgggtgaagttacattttatgtgtgggaatgaaggtgccacatcaaagttacatttttgtttacagtgttatgcaaaagtgaaactgtagataaatcatgggggtatctggttgcaaagaaaaaagttattgcatgctaagtttgattgatggattctgttccttgcggatgcattatgcatatgaaaatataggcattaatatcacttaacaaacctggctatacttaccactcagaaatttcacaacagtgtcttgttataggctataattgtttacaaaattaatttttggagacaaaatgcctatttaacacctaataaaagacacaaaagagaaaaaaatatataatatgataagtgatataatgtaataataaaaaagatagagagaaatgatgaatatttataaaatgtttgaaaaagttggatgtccagatatcattgtttttgctcaattgtttaagtgccttcaacttcaagagtattatgttacctaatagcgttaaagggcaaaccaaaccaaatggtgtgtaaatacttgatagataagtatgcgggtagaaattaaatcttaagtgtatgaaagaacatatattagaagatgttagttttttaaacgaatattaaatcataccttgaagaattaatctatgactcttgactagagaatttcttggattaaattaagaaaaacgtttgagatttgcgggaagtttttgtttatcgaatttagaaagatttcccaaataagatttctgtatcaattctttgaaactgaaagaactgtgtcaactatgtattgatatattcctgggccatcttccgatttgatatttgtgaaacttcactttcataaggtcgtcttatgctgggtgcatgcaatcattgacttgcatttgctcctagtcctagccactttgtgagacttatccatacgtgcttcaatctttctaaagcataaaatgtgaattttccgtgttggatggaagtaattaaaaagaataataactaaaggacagtgcgttgagacacagtatcgttcgttatagataaataactaggcatggcagcgggactcgaacccgtgagtacctgtccgaatccgccccgattttaatagaaaaaatcgaatttttcgggattgggtttggattcgggttttccccggtagccaaaagcaggggcgggggcgggtatggggttactgatacccgccccgcccccgccccgtaataaataatattaaaaaaataaaaaatattattttctatttttttaattgaattgattgattttgttttataattttaaaattatgatcccatattttaaatctggatttgttattattatttttttgttacataattaacttttttatccaattgttcaataaaaaaatatattatttttttatttttaaaattttaattaaatagcgggagcagggggtggggcggggaaaatccgacccccagcggggacggggatgtggatgggttttaaaacccgacggaaaacgggggcggaggcaaagagcggatttgggggcgaggacagagacggagaatgcaatacccgccccgcctcattgccatgcctataaataaccattcataaatggctaaacatgcaagtacttacaaaagacctggtttttggcatagtatgcaagtatcatactttataataaaaaaattcccatagctactatgtgtactaaaagtgttcgatcttacgaaatttatacaaatgatcatggtttaatattattgtagggtgtaaaaggtgggtttctgacagacattaacaacgatagtaaattgtagatttcatgcatgcatacatcttcataataccacttatcactaactaaaattatagtagctctcacaaaagaaggaatttaaattaaattaccgtaaaagtaattacatttttttaagggggaaaaaggcctctaataaaccaaatagataacttaaaataataataatataaataataaaatcgtacagttttgtactttgcattatctttcttagctataagccagtacctaactgatgggctgacctgtatgaatcagatttgtgatcgtgtaccatttgctctggctaataaaatcgcaaatcattttcaattattcgtaatactgttggatcatacagaaaaagactgtttaagttcaaccacagttgaacaggttttcttcgatctagataccacgtggtctcatctttcaacaactaattgaacatgttgctataaacatagtatagtactgacattcttcttaaatatcaatctctgttcttaaatcacttgtttgtttgcattcagattactaatttttctttaataaaacaattggaactatcaaatccactctcaaataatttctctcttgcatgtcaagctacgacaaaatactgttgccagagataaaatttcggctgaaatgttacaattttttttatcaaaaaatacaaaataattttttttttccttttcaccctattaagatcatatcttatcatttaagaacaacagtatccaaatttatttctatttcgatgcatgacatcatgttattaaatcctaacagtgtatcgcatagattaaatgagtttagtggaaggggatagttttgattatatactcaaactgtgtcatatacgcgaatttacttcattaacattgtgatcatgtgcttggtttatgacttcaatttaaacaaaattttcatatccaaagcctgctctttgttgctaccaatggcagaaaagcatagaaataattttggaaaatttcaggggatgcatactacatacaactaaagtacaagaaaagtggaacataaaaggagaaagacctaacaaataactaggcctccctaagaaagaaaaaaaagaagaccatggttgttactaaatcaaaccatgactaattgccgttgagcttcaattcttagatcttccttcatctttcgaatgaaatcttcaaactttttgttcaactcctctgtgctcaacatacagctttcttcttcttcttctacattttcttcctcatcttctatgctttcttcaatcagaatgtaatcagtttctgaccctttatcttcctcttcatcatctacatccaattgttcagtttcttcatctagctcctccttctcctcttctttcaaaaccaagctactttctttttcttgtccttcatctaccaaaatgatcttctcaatgttttcttgtacttcttcttcagcacagttttctatttctattacttgctcaactgcagtgttctgttcatcaggctcactagtttgttcctcagtttctactatctccaacattagctcgttggcttcaataacccaaaaccgagattgtgaaccatcatctttaatatacgtagaaggcttattatcatgacaacaactagacctggagagagatttagttataccaacaaaaacaaggataccattgcaaagtagaaacatggagttcttgtctatgttgtgtgtataaagttggaaagggaatgtagagaaatagaatttgaagtaatgtaggaaaacaagcaaggaagaaggtgagaagatgaaggaacacacggatactgaaacgaacaattgagtaagcttaactagatagtaatgagcttttaggtggtgagtcatggttgctatattttggtttttaagttgataatccatagtgtttaaaggaaattaaggaaatgaaatgacactaggaagggttggtgacacaggttctgtgagatggtgtggtttggtgtatgagggaggcctccttatatacaatggtggggtgagagattctatttttgggtttccaaaaatgcccttggatggaaaattattgtgaggcagatagcatattaggctcacctgctctttagagactttgtcaattgtcatgaagggtagtatccagttgtcagagtactatttgtaacagaaattgacaattgttttcttcaagttcgcctgtttgaggttttctacatgtcaagtggaatttttcaaagtaggggccatatagagagagagaatgaagcttaggaagacaatcacctccaaagtcacctcccactttaatcccataatataagtttaaaattaactgctcaatgcttatgtactgagtaattgtgactgttggatacagtgagtttgtgtttcagcgttccctatgtgagttatttttcatttccgcgtcaaaaatttaagaagatccaaaagccatttagatgcttcagattggacgtggattacaaatgacaaaagttaaaccaaacatgcattataataagtggcaacaatgatcaattgatcaaaccacataccacctgatacgtatattatatacaattaagtgtggagattaatttttttatggctaaattttactggatcttaaggagtttgttgatgcagaatataattgagtctgatcataaaaaagattctgagtatggtccactcggagacgggtgatatcagtttcagtcttcgtctctggaaattcaaaaaatcggacttctctttcctcctcctcgaggatgatggatccgtgcgctttccagaggcgaaaactgaaactgatatcacccagctccgggatattaattgttgttaacaaaagacctatgattcttttcattttttcattttttttaactatctaattcaccttatattaagcttgatattaattgattttaggttattttaatttaattaattgtttcaagttcgagttcaaaaatgacttggagagaaatttttgctttttataacttgatacaatttacaacatatattaattaatagaaccactttaaggttttaatgcattatcttgatgaattgttgcaaaaatataacccaattatatgcaattttgtgagatttatgcgaaatttttaactgaaaaataacacaacaaaactgcacttataaacttttttttcttttatttttcacttatttagattttctcgtgtacagttgaactgtttcgtggaagggttgtctgtttgtaggccaggccttgtttttgattgggcgggcctttttatctgttgattcgttcataaaaaacacaaccaaagaggaaaataaaactaaaacagtagaataccctaagcacaaccaaagattaagaagtccaaagcacggcttagcttacgaaataagaaatgatggaataactggtagccaaacagggcatagccgaagttgatgggtggttctacttgtttctgcaaagcacaagagcaaaaccctacttgaaccctttctttcttcgtcactgctcacaaacatcacaactatgtcgttgggaattcttcgatcgccagcgatttcattggcatcgaagcgattcctctgcaccaatgccgcttccgcacctctcccccctcctccttccgccgcttctcccagccgctggaacttcctcaaatacgccgtcgtcggcgctctcaccggaggcactgcctttgccggttacgcctcttacggttcgttttccttcatttccattttcagagtagtcatttagggttgatcgacagaatctagtaacatttttgtgtctgttttttttttttttcctttaagtcggtgttgtcactctgatgtgttagggttgttattgaatcattctgatctggaaatgacgttggttgaagattttttttttttttggaatgaaacatgcagcttacagtttggaagaagtagaagagaaaacgaggtcgtttcgtgaatcggccaagtacgctgccggtgatggagccactgctctcgatgtcagtattgaatatttctcaggctttcttcactttcattcttctttgctaattctatgttttagaatcatattgggggtttaaatatctaacctgaattgggttgatgagctggtcattggaacgttgtttcttgttatatgaaatgctctgcacatgctatgaatttaacgtttacatttgttcaacaaatttacttttggctccatttcattgcttgtatcgtttgcgtgactgtttcgtcgccctacgtcaaaatatacagtggttttcttttattgattttgtaaaacactttagtgatatcggattaaatcctattattttgcttcgtggaaatgccctcagtggaccttacttttacttaatgttggattctgcctggttttgatatgataatgataagtttcttaagtttaatgtatagtaaggtgacatgttctagtccatatcttgtgcagaaatttcaaggtttgctatactcaactgcaatgacaggtgtgttccccgagctttattccgtacacacttatcctgtattactgttattatgttcccttaaataagttgtgcttttgtttcttcacgtgaacttttgttcccctgaagtgttgctgttatatgaataggaaaacttgagctcgtcatttagatggttctgtatttctgttttgtgattttatgaagtgctctttgttatcgataagcatggacatctttttaattttactcaactgaaaaatagtatgtaaaggtcccatggggaaaacactgtttccattagtattaagtgcgacaaatgctaaaattaatagtcattttcaaataaaccataggtctgcccaatcatagtcattatatgcccctacttttgctgcagaaaaatattgcaaatggatgagaatgtgggatataagcatgtttgttgccaccacctttggagggtagggggtagaaaaggaaagtgagcagtggcaagaacttgttgtattgtagatgttgaagaagatcagtgcagacaaattagcattgtatgcacttcttggggggtgggggtattcaactcccaattagttatatatatgcatgccttagacctctgttattaacatcatgctgattcttttgcatgtgataccccagtgcctgctaaagcagtagagctttatttggatgcaagaaggctaattgaagaacaagttagggtacgtgcttgctttttaatatgctgatattggttttgacacttgtcatttaaaataaattatatttccttcctttgttttaatactgttctcttttgcttttttttagagttatactgaaccatacacagacaagctccttcctgatttgcttcctcaggagcaacatgtgtttacacttgttcttgatctcaatgagacattgattcactatatttggacggtaagacgtctactgcaaattcacccttttttgttggtagaaatttgataaactcctcattattggttgaaattcatgttgggtgactaaatcagtagtaggagactaggagccactaaatagggagtaagactcatgaatttcaaccatcagtaaagaatgtgttgcttacattccactttcctttatgtactttatgtcataaaaaatccattggatctctttttgtcttgcttcttgctggaggtccttacatattatagaggtatgactacaatattgaattttacttttatggtatgtaaagcgagatacaggttggcagacttttaaaagacctggagttgatgccttcttggaacatttagctcagttctacgaaatagtggtgtacacagatgaacaaactatggtaatctgattcttctctatattctgaatggatacttactcgtataggtattcatattcatatattcttacatttgttgatttgtgcagtttgtagaccctgttatagaaaggctggataccaagcattgcattagatacaggctatcgaggccagctactaagtatcaggatgggaaacacttcagagtatgtgtttatgttcttacattattctcttccagaattaattatatacataaatacctgtggaaggagtacaaccaatcatggcaaataataagaacaagtgccttggaaatattatatttttatctataaaataatagcgaagtaattttgcttacacctgaagaatataaaataaaagacctatggttttattatgatacttgatacatcacatgcatagtgtactagtggtgttctggatatttttataatgagttgttctttcctttttccattgtttgcttggcaggacctctcaaaactaaacaggaatccaggaaaagttctttatttaagtggccatgctttggaaagttgcctacaacctgagaactgtctccctattaaggcttggcagcagcaagatatagatgacacagctcttttggattttataccatttcttgagtgtaagcattccttaagatatattgaagaatgagttattgtttgaattattgtttttattttcacatcactccttgagtgtaagtccattcccttaagatgtgtttataaatgaatttatgtttgaagttactgtggtgactttttatgcttgtaaaagttgcattaccttctctgttatctatttgcagttgttgcccgtagtagtccacctgatataagaccagtgctagcctcttaccaaggatgtgatattccaagtgagttcatcaggcgttccaaggagcatcaaaggtagtatttaatcttttacaaaccttgaagattataatattttcagtatttccttaactaaattttgaaaatacaaaatttcagtatagaatttgtgattataacaaaaacataattaataacaagagaacaagtgaaatgcgctcttaagggaatttggtttgtttcaattcagttatgttttcactgatagttatgagaatttagtgtttttactgagttcatattggtggttgaaggtttcttttgtgtatatagctgacgttacactaatgatttatcctgtgttgtgttcaacccacatttttactctgggtgtttccaaatgatgcaggagaatgcaagaacaaaaaaatcgtggttacttctggaaatgagattcaatttcattgcaagttgatacaaatgatctttgttgagggtagataatgagattgtctgtttcattacaagttgatcagtcagttcatccaagattttgaagtcactgcaagttgacaagtgattaaattaaatagagaaaatgtagattttgttttacgtaagtcttgcatctcatgtcttgaaccattttttcctttttgcctattgtaattctgttgctggaaagcacttgttaattttggggatggagttctcaatggatgtttcttgcgaggtgatttaaccttgagtacatctctgcgcagaagaggttatggatgaccataaactaaattgacatgataaaataatttacttgattttgttgtttattttgttggaattttctgttctgacgccttgatctaggtacagattcttgattttgggcattcattgttatacagtgacgtatataagctatatattattgattacatatatataaaattagagataagatctattactttactggtagaaaattataaaatcaacaattattttcctattaatatctttcttttttatataaagaaagtgttgatggaggggggagactagggtccttttttgcccccttgaatctgtccctaatccccagtatcacacgacacaaatgaaagccctttaattattaatgcaaaattatttatgaaatagatgaaaatgagattgaaatttaacttttaaatactaattttgtttaagcatattattctgttttatatataactttatataaaaatttcaaataaattaaattataaagtgattttgtggcatattttaatttcataatgagacaacctcactttttgtttaaatatagtttataaaggtaatggttaaccttacttctataagagaggcatttcctttgcaaataacatgacaatgatagtgctttcatattaatatcgacaagagtaagagcacgtcaggagtcatacatataaaaaaatcccttgcaagataaagagtgagcatcaaaattgatcatttgggggatacgtaacatagtaataacaagcatataaactaataatgaataattgtcatgtaattggtgcatcataatgctacagtctgagccactggtctccatctatgaagctcttgtacaggaaaggacttgcttccggatagctgaatgattttgaccaaggcaccctatgtcttctatctgctcctcttcccttgcattgatactctgcaaacactgcagtcctgaagtaccatatatgcttagacatattctgcactatgaattctagaatggaataataatgtcatatttaaaacatagagaaaaactagcaacaaactttactattggttagaatgtattggaaatcacaatttgtagtttctaatgaattttaaccaataatagagtgtgttaaaaatatatgttagaaattgagttattagtacttggagcaaataataatactatcatacttcttcctatgtgaatgattccagtctgaccacccttgaggattaataatgccatccatattacatttggagtatataattcttgagtagttcccccatgctctgccaaggtatacactgccagatcctctaatactgcaccctacaaaagaaaaacccgtgtcgtctgttggtgaatccctatgatgtgctgctattgctccatagttctcagctattgactgaagacgacacttctgctccatagttctcaaggatcagaattaaattcaataaacttggtcactagttttgttttagtaacagagaaaaaagttcatcttatatttacctcatagagtgattttgccctgccacagataaaatcaacttttcctatgatgcgacactttaagaagtaatgatttcctgtgttgtccaagagagtgtcctgtgttcccttaatcctcactcgatagaacattgcttttggactgcttaccctcagtgccactccttgcatcccttttccaccagccgatgcaatcactgagttctgcaaccatgcacccaaagattggcatttgacatagtccaaaatgcacatgccttgtgttggaattggatttagtgcagtcacttttccacacattcagtacatttataaccattgaatgaaaattggactgactcagatttttaaatgtgtgttttaagttgattgactgagagaaaataagagtcgtttaaggctgaatggtcattttggtatctgaaagtgtatagtgattctaagttagtccctgaattcgaataagttaaaaaaaaaaaaaaagaaatccctgaaaataacttcttacatttacataatttgttagtttcaaatgttatcattaaaatgcagtttatcccttatatgtagggactttgcattttaatgataccacgcaggatctatatgaaactaacaaattatgcgaatcataaaagctaatttcgggaactttttctacatttatttgaatctgtggggactaatttggaaccactgtcgtttaatcttcacccaatagttctgaaatgttgaatgtgttgaaaagtgaatgcagggaatccagggtaccaaaaattgtgtgtccttacctcaaaagtgatcccagttgcacagaaataatctgagtccactcccactgttgctgaagcataggtgcccaatgctgtgccatttgggcctttgtcagatgacttactgttccaagtaataataggacttgcagttcgatttcttttccctataaatgatacataaggcttggtcacaggcacacgcactttttctctgcacaaattgcatatacacaaaggataaaataacataagtcaagtttttaatgataaaaaaaaaaaaatgtaagttcaaggccttgatgactcatgaaattttaggaaaccaaataaatgtaactgttggatcaaaaacaccaaccaaacccagctccgttaccccaaaaacaaaaacaaaaaatgtattttttcaaaaatatggattaatcaaggcaaacaattaaaacaacttcttttgattagaactgaataataatgacacaatagaatctaattgttaatccatgtattttatcatcaacttgatgaattaattttaaaatataagattttttccattatagcagactgtttagaagaatttcctattttttcataaaatattttgctttttcctgatactcgggttcaaatatccatggattagatgtttgtttactggcttcatataattcagaaaaaaaggacaaaacttagattttggagttgttcttcgatcaaaatcagagtttcacctcaataattcaagttgacaatttaatcaaaatctttagcatatggattactgaaattgaaactccatttataataataaaacaacacccaaaaagtagtatgaaaaaatatgcagttaagtactgacctgtaaattcctggaaaaatgtaaattttgaccctttgtctgttattatcaggaaccagattcacagcaccttgaacagttttggaatgtcccccaccattctggttaacagttataacttgaacctggttatgggacgacttcacggccaacctttgttcatccacctgcaaatcttcccaactaatgtaatttcgaacagcaccaccttctgctaaatccaccacctgagcccaaatcacgaaaaccgaaacaacaaacaagaacaaaactctggaagacaccaaccccatcatcatcattattgcgttgccacgcaacgaataagaaactcagcatgaaggtttgtgtatgttaaaaactgttgatgatgtgttattattataggagcaaagtgggaaaaagaaactccaaaatgagaacaaaaagcttgtgttactgatgaatatagtagagtaacggttttagagttgaagcgtggagtagctgattgcaataaatatgcgagcgttatatatggtgataatatacatacgtctgttccaatcctgatatattaggcatgcatctgttgatgttgttattatatatgaattataaagaaggagagtaatagctaggaaaataaacgtggcttttgtttttttagtttaatagaagcaacataaaaaaatcttttttttcttgttttaagaaaagttgaataacttatgagacttgccaaatgcatcagtagaaatagaaagagtgttgagtaactgagagtgtatttatttttatagaagaagagcggttatagattcatggggtgcggatattgggtgcaactgccccccactatgctcttctctttgttttggtgaactggttttggatctttctctatgcatgcctttcaaatgttctttttttccctcctttgtgtatatactaagtgcaaaatactcatgaaggcatggaagttaactgtgaatattttttttttttacacagtgatttgttttaaaaaaaaaagataaatgcagtttgaagttaaaatgaaatgttataatggttactgatttttaatagttggagataaaaatgtcaaaaaaaaaaacaccaaatagagttattttctttatgatagttatagaatcataaactactatgttaattgtcaccacttgttcaattttaattttcgtttagcaaaaaattattttgacattttgaattaataatgctatgaatgatgagattttggacaatcttgaatgtttgattttcatctggtaatagatgcactatgagatagattttttaacttatggttcagctacttctaggattaatgcgaatatttaagtgtttcctgcagagaaaatgttcagttcatgataatgattttaatgaattaagaatgtggtccctcctaaacttttgtgtgggctgtgacaaagtgacacttaaaattattgcaattgttttgtatacctatacctatgagatgagacgatgggatcaaatacataaaatgcaagtgaaattatttcatcaatgtaaaaattaatagatatttatggtcgtggttgactttaatatattggaaaccattttaaattaacgtgtgttgagcaattgtcctttctcgatcggggagtggacacttatttgatttttgggtggtaattaacatattgagttatttaaaagttgatcagtccattcattattagttaattacattatattcatatcctataattttcaattaatatttaatcaattattgggttggattgcacataaagaaaatagattctaatagcgtgaatccatttctttaaagtggtagtgaggaacctccacctgctttattagaaaacataacaaatgatgggattgaaaataaggacaataaatgcagctattgtataatcatagaaagtggcggattaaaaaaaaaatattaagtgagggttaaaaatattctgatattttctcaaataaaaaattatatgttttattaaaaatgataataaaaaaataaaaacaataaaatttaaaaggataattaggtaatggaattaattgtttcacaaaaatatttttttatttgaatatattaaataaatattttttactcctataaaaaaaaatagatgttgtcctcacacaataattttttaacaagataaatatgaatagttataaaagataaaaaaaaattgatattaattttatccactttagcttatatgtagatatgtcactaatcatagagagtttgtttgaatataaaattagaagtatttttgagagtttttatacgaaaaaaatactatattttcattaaaaactttaaaaaaaatatttctaacttgtattcaaatatatatatatatatatagagagagagagagagtatacaagagttagaatataaaaacataagtgcgctgaagagtgacgatagtgaatatcaccttaatttttacaacaccaaaaatcatttcaaattctcccttcattacagtccttggccatttaaggtaaaaacaattaataagcttcactcatgagtcacgagttgatggtgtcatgaatcataactctctcacacacacgcttccatcccccgttatattataggcaagaagttgttaggctcatagattcacagatatgaatttgcttcatttacttgttgtccaccgtttcacataagaaaaataaaggaattgcttattaagaacagtaaaaggctatggataaaggtaccggaaatgagagttagaaaatatcaaggaatgggaacttctgttttatttggttccggtgaagattcttggaattgtgcatgcacatatatatggaataaatttcatgttaataccgtgagaaatatacatttggtcatagaattatatacggatgtaaaattactatttaaaaagttttgaacaagtatcttataatttttatgactcaaatatagttttaaccaatctctatgactttcaaccaatgttattaatttttttttcatatataagttaaaaatttaaacatgtgtgacataaagattaattcgagaccattgacaagggatactctaagaccacataatgatttctccagcaaggagtctagattctttctggcccaaattcccctctagcaatatcttgcagcatctcagccccttcattgatcattgtacaacaattaaataagacagaatatagtgactggttttgattttaactaaagagaaatttttgatgaagatgcaggagaagaaccatattgcactaacggtgttaagcagtgatgcttaaacaagctttgtgcctaatagttgctcccaaataaacattgttcttatttagattagaacccatgtaataagcccaatggagacgtccttggactcatcccacatccaactcctgcaaatttcatctattgttgttataggaaaaagattagtgttttccaatctttacttaacacctatatagaaagagagaagagaaaatgatgtatatatgcgatatgatacaaagaaagacataagtattaattaaaatgtatactatgtgaagatgttcacttatcatcactcttaattttcaatatatctaatactatataataagagaacgaccttcttagccacaagtttcagtaaatattttccaactggatagactgggggttttgtgtaaggaatccagtaaacaaattgtcatcagattattaacaacaggagggctcaatagaggagaaagcattcacacattgatttttttttttttcgtctagattttcccgtgcaagaaattgaattttgatatgaaaagttaatttaaatataattacttaatatatttactataaaagaatactttgactctatatctaagaactttatataaaaattatattgacaagctctaagcatatcccccatttcaggttcttaaccatattgatcttggaaaatggaactactaaattaattaattaaacttgattaatctactttgttcatgcatatatcttgattcaggttcatagtatttttcttattcatgtatcttgcatttaataccatctagtttttaggagttgtgttgtttgaatgtatgtatgctgtaccaagaggtgccttgtacaatttagaaatactcacgtactagtgaatttgcatataagccaagaaaagaaaagaaaatccaggaaatcggatgaagtgagtttgtaagaaaagtttgtgtgttctccctttcccttctctacttatgttcttgttgtttccttcaattgaaattgagctttgacatagtagcagtcaagaaatacaaatcattaacagaaattataatattgtgtatatttcactgcaaatgaatcttttttttttttcctggccttttgtcattaacagatatattataagtataccatatacagttatttaattctgaatttttgtacattttttttcctagtaaattatgctcatggagttattttaattggtttgaaagttatgcacgatgttgttctttatgcttagtttagaaaagaactgttataactgtcaagctttttgatcctttgccaatatattttggtgaatactggctattgttcctagtggggtctccctaatacattctacacctcagttattgctggagcactattttcttgaatttatttgactatgttttgctctcctggctgcataagctttctttcaagaattttttatttttttaatcttgaagtagaacctctattttcttgaatttttttatcctctatcaaggctttttaactggaaaagactagtaactttaaatattgggcatatatagattttgggatttattcgagacatggagtaaccatattacacaacaatcaacaagatcaaatatgcacagttttggtggttattggtacaacatcttcaataatgcagaaatcagatttacttggctaggcatgaaatgctgatataaaaatacgaacctgtttaaatataggttaaaagtgtttttgagaatttctctattgaaaatataatatttttttaataaaaaaaactctcaaaaatatttctaatcttgaattcaaacaaactctaagaataacaattatttatcactttccaataataagaagagtatataatttttgcatgccataaaactcataatgtgtttggcaacatttttcacttagttcagagtttattttactagataaaaagtttctttaggcaaaaagcatgtatttggtaaaataacttattttaatagtttctgatgaattttttcctcaaatgctacctaaagtcacttttatattatgttttttaattattaaatataattcattttaaaaactaaaaataaactaaacacaaataattacaactaaaagttaaaatctcaagtaaattaaaatatgagaaatagaagtgcaatcaaacttttatataaaccagccttgtaggaaccagacaagtgtgtctcgactgccatgtttggtctaaaagaaatattaattttttaggtcctttactttacaatgtcaacaatacagttatctttagaatacacaagtttaattataaaaaatattttcgaagagctcagatatcaatcatacgcgaaagataccccttttttgtaaacagtttaattatgtgccatatgatacaaaaacaacttaaacaaagaataaagactcgcacgggacaagatatatatgatataaaatagatattgccagacataataaatagtgaaatatttgactacatttaatatagaaaaaagagttatacattgaaaatttagtaaaaaaattgaataatcattcaatgacaaatttattaatttttaaaataattatcttaaaataatttaacaataatttataattaaatattaataaaactattttaaaatacataaacattaaactctttaatatacctatacatatttaatagtacaacaaattacactaacatctaatttttttaagagtctaatgataatgaacttgtagtataaaataatatatagtcattttaacacaaattatttaataatttatgattatatcatagtgtaattaaatattttttattttagaaaataacagtgtcaatataatgtatttcaaataattaacataaactattgtaataatggttaaaaaatataaatgttttatgcggtttcaagaaattataagatgtcgctgtaattttctctttggtgttaatatctatttagagacgataacattcgcaatccataattctctagcactacaatattttcctttttactgttttggaaataaatctcgtgatctttcaccttttttccctatactataggtatcttctacaaaattaataggaaatcattcttattaaacaagttttttttttcacatgtaaaactcaaatttcgggaccttaaaaattaagcatatactacttaaatcaaccactcgttagtatgtataaattttcattttatctacattgataatagatattaattacaaaaacattcattctctcgtgtatgttaaaatcaccgctaatcaaataataaaatgttataaatatagattatagagtagtttatatactctttaatatgtatatattggaggtggctaagcccaaggagcatgaatgtgttgaagctatgataatggtgatgtcatgggttacatgggaataggaatgacgagggatgggaattgggtggtaatgtatattttgaaacaatttgactcaatgaaaccaaaggtggacttttccttttacaaaactggcaggttctaagactttcaacatataattaaataattcgcctttataaaatcaaatcatttcttagagtgaaataaatttattatattgtttttattcttaatgcatgtaattttattattgaaattattttatgctttccaaaaaaaaaagttaatcagtttaatttatgtatttccccccttttttatacgtcaaaagaatatatttttaactttatttaatattaacttgttaagatattatttttatttcttactctctaatacctatattctcaaattaattacttttgtgtgtactatattcttctaagaataatttactaatttagtctctttgtaaaattccctacaaaaaattgacacgtaattttgtgtttctaaatttaatttttgaaatttattcatacttacttttttttataatctttcatattttattacgtgtttcaaagattaatctacatgaattgcatttatacgtttttcataatgttaaatatttctcttaaataacttttagtttatattttgaaaattgaattaaatttagacatgttcttataatacacaaaatattttatagttataattgttgtcaaggaaaatactaatataacagttaatacgtatatcatacattacgtacattggagtttttaaacttccgtaattttttttttgaaatgatcaaaacgaagattaattaaaaaaacttaaaactatagttgtaatatgcatacctaatttataattattcatagaagaatactttaagaatttaattatatatatatatatatattattaaaacgaaataatagttactagataaatctattattatattatatattataatacataacttaattagaggtaggacttttactcactctcactttcttaattaattttttttaccaattaattaatttttttaatattaactttctttgtcttttagacgtgcatttacagcattgctcaaataataataaaaatttcttccaactatctcaaattactttttttagcctttcgtatgtatttcatctttttaggtgtaatttttttttcttatcttggtgtctaaattaaatttaaataattaattcaattatcaacatttaaaaaactgtgataatttaagttatttattatatgtttaagaatatttatttgttaaacttagaaaatataaattttgttaatatatggtgcatagaaagatattattagttattagtagggacaaacaaaaactgtatctttgacaatccatcaatgataaacgtttctttcaccttatataatgatggtgcatgcattttttctctttaaaaaaattgatattgtaattggaatctggtctcttggatctccataaccttcaacgtttcttcccttagattaggggcacatatcacatatcattccttccaaatcttctcctgaaaacaaaaccatgatgagaaggcattcccttgtgactgcatcaccaaaacaagggtccctcttctttgttggcgacgacgacaacaacatcaacccaagaattcatcctcacactcacacccttctgactccatcatcaaaacaagtcacagaaaaccataatcactccaaaaccttcaaaaccagtttcaatcacaacagggtaaacaccttgcacactggttccaccgtacaacatgttgaagcggatgaggccgttgaactggatgtgttgtggacgaagatgcaggaagaagccaaactcgatgtcactgtggaacccattttgtcttattactacaacacttccattctctctcaaaactcactgcaaaccgcgttggccaatcaccttgccatcaaactcagcaactcaagcctcccaagcagcacactttatgatctttttgtgacggttttggagaccgataaatccatcatggatgctgtgaagagtgatctgagagcggtgaaggagagagaccctgcttgcataagccacgtgcactgcttcttgaacttcaaaggctttctggcgtgccaggctcacagggtggctcacaagctatggtttcagggaaggaagattcttgctatgatgattcagaaccgggtttcccaggttttcgcagtggatgttcatccgggggctaggattagaagtgggattttgttggatcatgcgactgggattgtggtgggagagactgctgtgatagggaacaatgtttcaattctgcatagtgtcactttgggagggactggtaaggtttctggggacaggcacccaaagattggtgataggtgctgattggtgctggaacttgtatcttggggaatattaaggttggtgatggggctaagattggtgctggttctgcggttattaaggatgttcctccaaggactactgttgtcgggaacccggctaagctggtaggagggaagaacaaccctgttaagttggataagattcatagcttcaccatggaccatacttcccatattgctgacttttatgattattgtgtttagactttagagtgtagcgtaatgtaataatcctcaagcatgtatgatttggagttttgtgtttaggattttaggtgaagtgattttgatttttgattggggctgttcttttttactatttgagtgtgtacaatagcagcaatgagatttgaacctaggacttcatgtagactactcaaatctcttaaccactaggccaactctggtggctactggtgctgttcttgtttgagtaatagagaattcatgttctcctgctaacaataataaaagcgaaaataatagtaacagcctaacaggaccccttgattacatgatgttattgttgggtatgtacagaagctgtatttgtgtatgtatgcatgattgtgttgttgtaagttgctgtatatgaatttcggttttcattgctttcattatctattcttcttcttgttatgttgcttttccttgttggagattaatgtgtgagtggtagtctcactgggctgtagtttaataaaattaatgtagattgtaggccatgaagatatatattggatggtatgcaccttaataagggtagtgctgataggcttttcagtcgtgcatccagtgctgttctcagtttgagcactcgatcgtttggaatttataattttatgattgttcaaatttccattttttttaatataaaagtccaagactgggtgttataagaataagaaaagccagttctttcaatcatcaacatcaaaccatctttgcaagagcttaggcaacatcaaattcttatccctgctaagttgtttttatttctagttatcgtggtctgaggtattttttcagaggtagaacaaaggaattactctttcagacctgtacttttatgtgttggtttatcatagtttttgtaatctaacatgtcctcttaagcaagagcagaagctcttcaaattaaaagcatagactaataaacaatgcacaagcttatttcatgttgttctaattttaaagatgaagttcttgtggggaagttattaaattgctaagcatctaaaatttgaaggaagatatatgaacaacactgaaacggatataaaattaacacaaatttttcaatttttttgaagtaacacaattttgacttagtcccttcctggggcaattttggctttcactatgtttggtaaaaggatttgatggtgtatgcaagtgcatggtatttggacaagtaacagatggacatggttggggtacagactcgccgcattggaagtccaaagtttctaactgctagtctttaggggaatgtactgcataaaaagcttgtcatcctatgaaagccaatttcatgacggaacatgataaacaagcaacaaaatggctaatagaaattctgaatgttgcaggccaaatacaaatggttaagataatatgaatattcttgtattaacttaatcacagctacgaacactggtatgaacaattggtacacaatgctacaagatccttcatgtttatgttattaaccaaatgtgcactgttttcagaaaatatgattttatacctactatggtatttcttcaaaaagtatatttatttaggaaaaaataaaaggaaaatggatggttttataggttgtttgattgtatacttaagtggaaggaaagaaaacaaatgtatataaaatgacgcgaataatataaataaataaataaataaaaatgtataagaaatgaggatttttttttaaaatatttttttttctttaacccatatatatttcatgggtagaataggtctacttaggctaacaagcttataattctttttttacaagtcttatcataaaatatacttttaaacatgaagattagactagatcttaaaaaatgcggctaataaataaatatgttagattcagactttgtttatgtaataaaagtcacttttagacctatcaaaacatatttggtgtaatctattttcatctctattacaaactttttataaaacaaatacatcttatatcacttataaaagtttttttttttgctaacatattacttataaaagttttaaaaaatattagataatgttaaatatctattaaatataagggatataaatataatatttttcttttgtttttgattttatgagttttcattttaatagattgatatagagatttgcaatagttttaaacagtcttaattgtgatgcaatttaatttagttttacataaaaaatcatttgaactaaacatacaactcattcaatttgatttgaatgtaatatccaatttgaaccaagtaaaactattttttaaaacttgtttatgtttttttttccttattttcttaaatttattttatgtttgactttaaaatatttctaattagacaaatagcaacacaatttgatacggcgtaaaatatataattttattattaagtaatgatcaactattaaaaataacgtttaatttttatcaattatttgtaaaaaaatatatttactaatatgaatctaatgaagaaaaaaaaatcagagacctagttaaaaatttagtaaaaaaagatgagacctgcgggtcaatttaactattttttatgtgatcagttttctatttatttatttatgaatttagcactttaaaataattatttgttgagacttgagatattttcttgcaaaatatacaaggagtgatttgcaatttgtataaacttgtcatgtgacccattgtgcaagtaattgagggggattcataatcatttgtatcgaagaaagaagcgacccaaattcgaagaactttgcttccttcaaacttcaaagtgagatacggggctcaagatcaagaacttcaacctcaacctcccttctctgtcactgtgactttcgtttcgtatcgttttattattatttttaattatcctactttctctttctctcttctcattatgtattcaaaaccctagctaggtttttggagctccctttctttccgatcccaccgtcaaacttctctttctatatgttttgcagggtccattgaatatgtctccgtcgttggatcttcctcccaagggtggcttcagttttgatctatgccgaagaaacgcaatgcttcaaaacaagggcctcaaagccccaacctttctcaaaactggcaccactattgtcggtttagttttccaggtctgaaatcattccctcgctcttttcatgtctagttaacctaattttttcttattattatatatttaaacatcgctgggtttttatttgtttttctacgtgtttatcttcactcttttttatctgcttctttattttgatttttttataccgtaattgtgagtgggttccaatggaataatggatccagacacatgatgtgaagttatggttctgcttggaatctcgaatgaattagataatttgttttggtagatagatgtctggccttgtgaggtttcgctgtgcgggtgaaggaaattcaccttatgtaaatgctataagttttgggtgttatatttgcgtaggttgcgaatgttgaatttttatttatttatttttatgttagggaaatagttggttctgaaattgtgcattgttttatagcaagagaatatgggaagcctagtctggctctggatatcttgacttgtatgttttgaaaatctacgtgactgtttttgaactcaatttctatctgtaaagtagtaatattagtctattactactctctcttttctctgagaaatttgattgattttttattctaaaaatattttaagtaaaatgttaatttttgttctaaagtatatgaatgattttactttagaaacaattggcaagaaataaagtcataaagctcctgcattgatttataaattttgtaatatataagtggctacttcagtaactgctaatcatattgacctcaacggtggatattgagcatggttaagcttttttcttgtctacattgttccatctagctggggaacaatcaacgtggttgtgattctaatgttacagctgaggtttaatatgaagattttgtatcataaatttgaaaccaagttgctccgtctacagagtacagactgatttcttgtgaaacagtccactaactgggaattgtaacatttgtatttgtgctgttaatgagacttttcatggcaatattatctattccaaacaaagttttatgacttcatatgttgattgcatatttatttttaatgtttaatttgtatattgtaatctaaagctgaactttcccacttaataaatctgcctcaggatggtgtcattcttggtgctgatactagggcaactgaaggacctatagtggctgataaaaactgtgagaaaattcattatatggcacccaacatatattgctgtggagcaggcacagctgctgatacagaggctgtaacaggtatttgtttaaaatgcatttttcttgttagttgttacacatttttacgttatgccttatggatagttgcatatggaccacaactttagcttttgctcttgttattattgatgtagtaaaattgttgaaaatgagaagtttgttatttactgtagacatggttagctcacagctgcaattacatcgctaccatactggtcgagaatcaagagttgttacagcactgacccttcttaagaaacaccttttcaagttgagtttcagaattttctcatcaatttaattttctctctgtatcaaccactgaatctgactcttttaaactattgtgcagttatcaagggcatgtctcagctgctttggtgcttggtggggttgatatcactggacctcatttgcatactgttagttcattgcttaaaacttttcttttatgctcaagtttccttgttttggatgcctatagctcaatttctcatgacttgttttgcagatttatcctcatgggtcaactgacaccctcccatttgctacaatgggatcaggttcacttgctgcaatgtctgtatttgagtccaagtacaaggaaagtttgagtgtaagtaagaatttaaggctcacagcctcatacgttagtaaagctctacgttagagtatttttgaggaaattcacccttagaggagtgcatttgatacattgttgtgaaatggaggtgccatggcgcgatgggttttgctaactgcctactatttgtgaagggaggcctgccatggctgtgccatagaccacaatggcatgcttatatggcagaattcttgccttccaccattgataacactgatttgataatattctgtcaaagctgttcaatttataataatttcaatggaacaatatgaagcaaatatgtcaatttcaaatctaaatgtaaaaattgtgcattatatttgttataattgatactggtggtgtttgtaactttttatcatgttgaaatgctgcattttgatagagattttaatttgatataaacattatgatgtggtgtagagggatgaaggcattaagatagttgttgaggcgatatgcgctggaatatttaatgacctaggaagtggaagtaatgttgatgtttgtgtgataaccaaggtgagtgctttgatgatcaattgtacaggttgttctttgatgagagtcatctaactctaatttctgcacaatttcttcattaatgcttcacagggacacaaggaatatctcaggaaccaccttctaccaaatcctcgtacctatgtcaatccaaaaggctttgatttccccaaaaagacaggttagttgcgatttttgctaatttaatatacttgagactgcaataaaactatattgttttgcttagtattgtgtgtcaaccgtcaatagtttgtagtctagcatgacattgtatctcaccttgtgacaaatatgataatcttgggaatttggtgttgtgaagtatcaaacttagataatagctcaagttagacaagcccctttcaacttgttgctatatgattaaataattgacgtttgacagagttgtcaatttgacgttcatgtttttctgattaaagaatatgttagatgagtacttattaactaagggttgagatgagtgctctattaaatgagggttgtgtgttactgtgtggatgagttttgggtcttaaagacccaatccatgaaacacaaatatgattatctctttccttttgaagttcctataacaaatctactccacttattattgttgttgtttaacacaatgttacacaaatacacaaggctacatatagtagaggctgtatgcacattaccatgcatgatgcatgtcatatacacaattccgttaactatttaaattaatagttattaaggggattacttatgctgtcttacaatttaggggtttgattgcttcaattggaagcacaaggaggcaaattgcacataatcctaagttgaggagtctttgtataatttttcctagataatatacatccatgacatttttatataaagcagaattcctattgagggcttgagaaaataattaaacctttaatggcctgccctttctgtgtctgcccatatctcctgtttcctttttttttttttttaattctagctgattaaacagtatggagaaaattcctttatagaaattattttacatactgtactaatatacattctccattgcagaggtcctcttaacaaagattaccccgttgaaggagaaggtggaagtaattgagggagatgttatggaagagtaacaatcgttccaaaaaatatttggtgtttgagtatgaaacttgattagtgcaatggctgtgatatttagttattgtagtttcacaactttggctttcattaccaaaaaatatttgaagttaattagattgttgcaagttattcctcaaatttcttcatctggttggattttgactagaaaatgcttaacaaaacatcaaatatatacaatttgattgatgaaagatgttacttgttttgttttgacttttcaagctttatataaatataaattggtctataatgagattaactttgttagtaaattgacaatttcgacaggcgtacttgctagcaagttgacaactttaggaatcaatctgtgtaagggaggggttttatgtacagttgaaatactatgccacaatctgtgttgacagttagttttgagtcttttgacaatagagtggttttatatttgtgaaaaaaattattgtttgagcgagattaaatttgtgaaaaaaatggagattaaattcatcaaattaacatagtggaaagaacaaaagtataataaagttattgtttgagcgagatttagagtgtaaaaaccattatctttgttttttttttttttttataaaaaagagtgtaaataccatcagaactttttttaatgcaatactattagaacttctgttattgttttagtagatcatttctttcaattaataacattttaatgttaatttataaatattttgaaaactaacattatttacaaaaatagagtattgtataaataatggtatttcaattgaatgtttaattaaagtaaaacttaattttaaaaatttggtcattcaacatttatttatttatgatgaattctaaaataatttgccatttgatatatgcatgagtattatataagaaattttaaatattgctaacaaataaattaaatctttggttaattgtaacttttctaatttaactcaactaaagttttgaaccctaactttattattttttctattaaatacatttatatgatgatgttatgttttgtaattaacattatcaatttatctatcaatgtttcagtacattatatttgacattatcgaatcttactacatatgatttttacaaatgaatatttacattacacacttttaaaatgtataaccaacctaattaaaaactctaattttattttttgtgttccttaactacatctatttgatgttcatatgttttgtaattaacattataaacttatgttacaaggtttgcatgttatatttcatatttatgaattttattatattttcttttttcacctccaattttacataacatgataatgtgcatttaaatgtataactaatctatgtatatgcgcacgggtcaaatactagtttaaactcaaataaaaaaatgaattttttaatatttactacatttttataacttattttgtgcattataattataataaaagtatttttataattataattaaattttttatatcattatcatgagctccctatatagagccccaacaacaagacacgtgccaacatcattaggctgacaaaaccaacatccaataaggctcgacactcttgagaagcataagctgatgaagtaatcattttgtccaccaccagtttgctatcaaattcaaagaatagatctatgagacccatctaaatagcaagagcttcaacttcttcaacgtcacttctattggaatcacagatggacaccacttctgatcaaattatatgggtttttttccattaatttatttatcaaggactatcaatcattgattgaatcgatgaagctcctatttgttttagtatttacaaattattttttcatacttttttaattaaaaacatgttttatgataagtttatagttaagatcaatttaaataggtacatgcatcttaattatacttaacagttcaaaattaatttaattaaaatcattttctttctaacttttttataaaaaaactaacccagaatttaatgtttacaaaaaattattcaaccaagcaattaagttcaataatactaattcaagaagtaagtaaataaatctttttctaatgattatattttaaactattatattacaaattatcatttatcttaaatatatatacacagtatcataagaattaagattataatctctgttcatttcgaagaactaatctaatgactatatagataaacctcagcatcgaaaattaaacgtatggccaagagtcgtgcttgcagccatttttgaaatattaattgtcgacgacttttctaaccattatctttgttaatttctaattaaaaatcagtccattttctcataagctaagaaagcagcagcagccgcaccagtaccagctatatttcctcgtttcagcaccaagctgtgaatttgtggtttaaacctcaacattacttcacagccaaaccatactttttcaaggttataatcttgatttataagaatggggttggagcttcatatttccttatctataatccttcctttcttcctcttagtgttcatgctaatcaacacactttggagatcaaagaccaagaattcaaactccaagttgccaccaggaccaaggaagctacccctcataggaagcatacatcatcttggaactctacctcataggtccttagcaagattggcaagtcaatatggttctctcatgcatatgcagcttggtgagctttgctgcatagtggtatcttcgcccgaaatggcaaaagaagtgatgaacacacatgatatcatctttgcgaataggccttatgtgcttactgctgatgttatcacttatggctctaagggcatgaccttcagcccacaaggaacttatttgaagcagatgagaaagatttgcaccatggaactactagcacaaaagcgtgtccagtccttcagatcaatcagggaacaagagttgtcaatttttgtcaaagagatatctttgagtgaagggtcaccaattaatatcagtgagaagattagttcattggcatatgggttactatcacggattgcttttggtaaaaagtccaaagaccaacaggcttatatagagcatatgaaggatgtcattgagacagttacagggttttctcttgctgatttgtatccttccattggacttctacaagttcttactgggattaggactagaattgagaagatccatcgaggaatggataggatacttgagaacattgttagggatcacagagaaaaaactttggacacaaaggctgttggtgaagaaaaaggggaagatctagtggatgttcttttaaggcttcagaagaatggtgaactccaacaccccctgtctgacactgttgtcaaagcaaccattttggtcagtatgtttcttaaaaatctatgcaaaaggcaaagataattatatccaatcaaatagttctaggtatgatttttttcttctctcaattgatgatttgatgcagtcaaaataggattgattatattgatcttgaacatcttttacaagagaaatgttaatgacaaattctctaatacaatattttgaacacactttttatttactgaaatttattaaaattacatatttgtaggtcatacttcttatttattagccttatttatgattttacaatttttaataaattttaactagtaatagaaagtatgtcaaaaaggctgcatgttgctaaacaggccagagaggatccgaacttgataggagtgcgttagaaagagtgtatcaaagcaatcttattgtttaatattttacatataaaaaaccgtccaaaatttccaaatctgagtcatttagtagactacctcatcagtcatcaagagctgtcctgggtgcacttcatattttaatttatatggagttatgtaatgaatattgatctaatgttttgaactgagccggttttaagttattcacacttaaactatgacttacattaaattaaactgataaatttctttctatgataaattctggttattattgattaatctcattagaaacgtaatactaacaccttaacatttctgtcaggacattttcagtgctggaagcgactcttcatcaacaataattgtttgggtaatgtcagaactagtgaagaacccgagggtgatggagaaagtgcaaattgaggtaagaagggtctttgatggaaaaggatatgtggatgaaacaagtattcatgaactgaaatacttgagatcagttatcaaagaaactttgcgtttacatccaccttctccattgctgcttccaagggaatgcagtgagagatgtgagattaatgggtatgagataccaaccaaaagcaaaatcattgttaatgcatgggcaattgggagggatcctaactattgggttgatgctgagaaatttattcctgaaaggttccttgatagcccatttgattacaaaggtggtgattttgagtttatcccatttggagctggaagaaggatatgccctggcatcaatcttggcatggttaatgttgaattctcacttgcaaatttgcttttccattttgactggaaaatggctcaagggaataggcctgaggaacttgatatgactgaatcctttggcttgacagtaaaaagaaaacaggatttgcagttgattcctatcacttaccacacagctacaagttaaggccataactattgtgttattaaaatgaggttgctctcaaacattataatagcatggatttctttttttttttttttttttcttgtgtgtgaatggagcatggatttcatttgattgttgactacatcaatttgttagccaaactaactagtctcaatctatatcaccatatagattacaatttgtttgtcaaactaagtcaatagtcaagaactctatgctagtcaaatatttgaaatttgtgttgtgtacttattattagggtgttgtgtacttatcattaagcattacccataataacacctatttgaaattttttatatctaaattgttgcagattttaatatgaaatatttttttatatgattttctaggtagattttatttttatatctgataaagtatctttaaatgcatgattataaaactaattcttttaaggatgatggtcaaataaagttattttcaaaacaacaattcttgaattcttaatattgaaaggaaagtttatataaagtcataattcattatggtggttattaaaaaaatcattttcattaaaattatagataccattaagaaaataatttgaagaaataattaatataaaattttgaaatttctatattttgagaatatttttaaattcaaagacatgtatttttcttcatttcaaagaatcactcttaggtaaataatataataatattaatgatattatattttattcaaaatatgtatttaaagattgactttgatttgaagcacatgtattttttaccattggaaaaagtttgtatctccattatgaaataaaataatttatagataaaaaataaaatttgttatatataatttatttgactaattgaattagtaatattttaaaatgatcctattctaactaatataatattctggtaatattcaatttttatgatattatagaataaacatattatttatttttgtatttgtatatagtatttcttttaaaaactatccaaatttcaattttggtactttgcgacaagacaaaacaaaaagtatatgaagtcaaaagaaatactctatttaatagatagattgtgaaaaactctgtgtatatattttcatataaatatgcaccatgttacaaagttaccaaatattttagtcaataattaatatttgtacttgattttatttaattttgactaaaaattttaaattttctatgtactatatatttcctatagatcttatagttttaaataaattaaaaaaataatcttaaaaattacttaatagagattggttgacttaaatttaaaatcttattatctaaatttggaattaagataattttatactatatcattcgtatctttagaacatataatttgaccattgtgtaaaataatttactttaaaaattagtttagtttgatatcatgctaacttttgctatattttaaacataaaagacaaaaaaatccccagcagatgagacataagtattcgttgttggttttttaaattagcaaacaaatatcattaacttggtaccagtggtacccaaataaaaaacatattacaaaaagagaatatccaacttgaagcaatgaggttaagctgtattaatatcaactaacataggaatatttattaacctcaagctaacagcctgaacatctcaaggaatctgcatatttctatatcagaaaattatacccaccccagataacatatcccttctcctgttacaaaaaactctgcaccttagccttacccattgcaacccaaaacacaacaccacaatgttgatctcgagtgtataaccctcggcccaactcaccaaagcattccgattaggcacaaagaaggcaagtgggagtgttgctactccactggacaaaacaacaagtaaagcctggtgtcaatgatctcaaccatgaccaaacacagaagttaacatcctgtaccatatcagaactttgagcagaatctatattaaaaacaaggttattccttttcttccagacacaaaaaattactgcactccatataaccatccatatattgcattcagctgaagaccttccaatgcccgagtggagccaaaaatgatcttgaagtgatttcggtaaagctagagcaaaacctggcgaaatccaactgtgacattctaaccagattttaaacacagcttcacagtttaagagtatatgctgcatggtttccacttgttgattacagagtggacacatcaactcagcttcatctgtgataattcccctcttccacgagttatctttagttgggaagcctatctctcaatgctctccagattaaaaatgcaactttccttggtatatttatccgccatacctctgctaaggtgatatgcagggcctctgagccaccatctagtgttcattgtgaatatgcagaatttgtagattaagtgcccaaagggcttgctctccaaatccaagaatcaacaatgttgttatgcgcctgcacagtttccaaaagagttgttagttgtaaaaacatctccctctcccactcaaaaggctctcttcaccaaaaactcccaagaccatatgccattcctccaaactcccatattcccgatcagctccaacttttgttccgagattaagaataaccttggaaactagtttgccaacaatttccatccacccaagtatcaacccaaaatctcactatatccccgattcctattttccactggatcccattatcaaaccatttttcttgattaagccccctacacaccctctttaagtccctccaccacaagctttccaacgaagagctatcctcactcaagagaccacaccacccatcatattttgacttaagtacatcaccccatatccctttttgattgtgaaagagattctacctccacttctccaaaagaatctcattgaacaactcaatctttttgacaccaagacctcccttcttctttgacaaatatcattccatttcacccaagctaatttattaatatcattactccctccccacaaaaaccgtctttgtattccaacaagtttagcgcacactaccgtaggaattttgaaaaaggagaggaaaaatagttatatggatgataggatggaatttatcaaacaaaccctctcccaagagaaatatgtttatgcttccacaacgttaaactcttcttaaatttgtgattaaccagttgccacgactcctatattggaaaagaagatatttgagaaaatgaaaattttaaaaagatttggaggaagaaaatattttattattatacaactcgttttatctattggcttgatagaaaatagtggaaaactttcatagttatactaataatacctccttaattaataagtaggattctgctaacacaattctcatctaatgactataaatcattatctagaattctccacactattttagcttaaatatttatgattgtgatttctagatacaattattctttagatatttttatgaaaatatctagagtaaattattctaaattttagactaaacatctcttgaatatttttagatattaaacaatttaacaactaagttcaatatacctaaaccaaatttattattattcaacatcctctaacctaagattagtcccgatcagtaatccttgataaacaatcagtaaagaaaggattctataatttaacatacttacacaccactccttcacctcatccgccaaaccaatggatatttggagacataagtgttagtactaatggatatttgaagtttcaagaacatctatcatcactcaatatgtgataaatcctagtagtatatagggctaaaatctcgtgtattttttttttctattcacatgaatttcacttaaaaaggtataaactcctttgaaaatgaaagacaaaaacggaacttaccgaaatgcagaaaagaagagtataaaaatattagtcaaattaaaagcaatgtgaattaatgcatgatcatatatttatttatttgtttttgaccaaatgcatgagtatattagtcattccaattgggtgtgaacacacactgtgtttactcactaggaatgcgtccttttagcttaccgaaactgaaaaggtgtattggtcttatttgacatacagacacaaaactttactcattcaaatcctttttattttcataggcttcaaaactggctttggtttttgttcagtaaggccttccctattcctgtgctactcacttcatcttcttactctccctaccttgaaaaaacgtgttttttttttttttatcattgtgacatagaaagcgtagcgtagtacgttcaaatctcacttcttcttacgttccttcattctctgatactgataagaaagtctcattctgccactgattttttctttctatctttttcacaggaactttacttgtagcaagcaattgtaacgcaagcttcttccttgcccattcccccccaaagtttgcgacttttgagattctcatggccttccaactcaaactcgaacctaggtctccgcctatgtccacttccaccacccagaaaaactacaaagagatgagcatttctcagcttgtctcggttttgcgtgtttcgtttcaaacggaggattttgacaaagttgaggaagaattggcgaacagggacgccaaatttaaggcggagattgagccactccgggagaagatcgaggtggagaggctcaagaggattgaagccgaagaaaaacttaaaaatagagatgagcaatgcgaaaaggggaaaagagcacagcaaaactatgagcagttgttgaaggaagtgaagaaaaatggtttggttgaaaaaaacatgattgacgagttaagaaaaatgagcctcgctttacaacgtgaaaattgtgagctgaagggcttaaaggaaaaatggctagatgaacttaggagcaagatcagtgtgttggaggaggagaaggatggggacaagagtgttcttgatgcccttagcacaaagaacagtgaattggaggaatcgataaagaagaatttgacagacatagagaggttaaggaaaaagaatctttctctagaatgtgaagtctgtgagctgaaggaattaaagaaaaaatggctagatgatgtggctgaacttaggagcaagattcatgttttggagggggagaaggttggggagaagagtgctcttgatgcccttagcacaaagaacagtgaattgaaggaagcaatcaagattaaattgaccgccatagaggggttgaggaccgaaaatggtaaattggcagatgagaagtgcagacttgagacattgatggagaatttagagagtaaatttgcggaaatcggtgtcaggattgtgaagttggaagatgctacacagtctttgttagattgcttaaaagctgaaggaattactgtcaaagttgaagaggttggtgactacgagcttgaaaatgacactgggggccatgttcctttccaaaggaatgaagatactcgtcactcaattgatgctcagtctcgtagcaaagggaataaggatgctctaggtgcatcaggtatggaattctgcttgcatcaggtatggttcaaggcccagctaccaagaaatatgaacaaaaaaaatgcatcaagaattagatttgcatttttataatgcattttgttcatatttcttggtagctgagccttgaaccatgatgattatttattggtaatggctgtggtcaagagccatgttttagtaacttaattgagccggtggggccattaattattgctcaaattggatgaattggtgactgaaccagatcacattaaaatacttaaaagctcatcacagtttgcaattataattagacacaatttaagaacatacactcctcacagcatccaatcttgtttttgaagtgaaaatgtcacagttccccataagtttcaagtttgattgaccatgtttacacaatgaatttattaatttggagaatagcctaaggtgtctacttgcaaatgcaaggtaaggctgcccacaattgatccacactgtaggtcagacacttccttggacccccacacagggagctttatagcaccaaattacccgttttcagcctaaagtgtctacttgtgaaaagaagcctaaggtcaattttcctttgttatctcaagtaaaacacagtattgttcctgttgtcttcctttgatgttagacacatggtttgatttggagagtcctattatatttttgttcccttagaaaactgcaagccatctcttgtgatttttttcttttttcccctgataaaattttctttcgatgagaacaaaagaaagaacaaataaaagcaggcaagataacttgtttctcccatacaaacaagattacatgatacccttctatacatattatatgaatttgataaaagtatacattgttaatcacttgaagagcttgaggctggattttcatcaaatgctgaggcaacaaccagtttctatttgtattacagaatctactaatctttattctcctagcttttgcttgaattatcatgttaacaaaaataaattttatgtaagttttaacatatctcttttgtgcctgcagggttcaaattggaatgggaaaataagatcataaacctagatgatgatgatgatgatgatgatgatgatggtgatgggtgtacatcaaaaggattgcatggaaagaaagccatttctcaaattattgcagaaaatgaacatccaagttcatcgtatgcaatccagcacaaaagcatttttacagaagcacaaaggattgaagaaatcaaaacaaaatatttatctgatatgcagaattctacttccacatcttctgatgatgatgattcatttgagtttgacgaaggtaatcctcccaagagaagaaaaactgcgccagacagttctggagtaaactctttgccaaggtaaatggagcaatgagctatgttaaatatccttagccatatacccttttgtgtggttatattgaaaacaactaactcagtcttttgtttgtccagttacttcctcactcgcaaaatctagagcaggaggttcccagccaatcttatatgcagaagtttagattagtgcttagttttaaaagtattcacatgttggaatcgtatattgcagatatggtagtcacagtatgtttgtatttattaaatgtactttatttaactgataaattctatgttacctaatatatgtgtttatgtatggatgcataacgagatatgtagagaaactgtgcattccaatatctagtaacgtccatatctttgcttaccttagattcctctcagtgattaaaggtctattgaattttgaaaatcgataaattaagtaccaagataacctaacgttttgaagcaggagattgataccaattttaagtagccaacgttaacttgagcggaattgattgaatacttttgtatagttgaagttgaatgtaagaagataataaggacaaaaggagaaaaagtaataaagtattttaaattaaagaaatacgaacatgggtgatgggggaggggtgacttaccaaaaaatgagttatgagcattttgaaggaaaccaagttctctttttcttggaacatttacttaatcatagctgcttaactttatgctcctactaaaatagtaataggattgaaagaatgggatctaaaattgaatctattttgtttctttgatgccaaatgcttcatttatttatgtttcctcaatcggagtagttccattgggaacttaccagctataatagtaaaacaactgtatttaggggaagttcaatattagatttaccaaataacatgagatactaataaatttgtgacaaatagtaatctgtgtctttatagtatgggttaagaaattaaaaaaaaaaaaattatgggatacataaaattatactgtttatgactgacttttttacattttcatatgattttcacaataaatatttgttcattttagttctattattaatgctctaaaagtattacttagtaagattctaaatttattaaagaataattagaaacgtgaataaccaatgaaatagttaataactggtggacacatcaatcaggtcctctgatattggtagtactttggtttgttgatcttgattggtagtactttggtaattcgtagtttttaaataatatttgttctcccgtgagcatttatgaattatgagaacaagaagaaataaaggcgggaatagtttcatgcaatattccgtgtaaatttaacaagaaaaaaatttaaaattataaaaaaaatacatactgtatataattaatttaaataattaactaaaaatattaaccactaagcaagtagtgtaaattcaagaagaaaattaaaaacactttttaaagaaaattaaaagaaaaaattaaagtacaagtaaatgagatttaagataaaaataataatataaaagaaaaatttaaaattaattgaaactaaaattatcgtggagtatgcatgagataaggaaaatgaataaagtcctcgggctaaaattaattctgcattcatctaccaaagttcaaagatgcaaagtatctatgactctttctattactaggtttctgccatgtatcatgcatgcagtttcttgcaatctatttcaaacatcacatgagagaacaatgcctgcgcagctgttataatggcccatctcaaacaaattaagtacctcagcaacatctggttgcggatgctaaaacatcaccggtcggcctctccaatctcgaaagataaattataccaaatcctgtaccttaatttggtctttttcactggggcatcaatgttgcatttaactacatcttggggtggaaacttctaaagattattggtcaaaatcatgcatgcgccactttaaagactgaaacagtatatatctgcttttgcaataattaacgtgctccactgtccaaaatctactctcaatcaaatagccaatgatttcttcatgttagagttggtgacccgaatttttggtgaaaaatattttgagaaattttcgggggtctgtagtggcagcagccatccctgctgtatggacctttattgtgataaggttttacattagcagttacaaaatatatatgctgctgtaacctaaccgcttgtatgcgttctcttgtaccttttttttttcaacatagtaaattgtttctcatttgctcgtgatttttttttctgaaaggattttctacttaaaatctgtatgttaattcttctttcctttatctctgttgcgcatatatttctacacttcacaatcagatccattcaaccatgtagatagccaatcagagaactgctgaacatcatccattcaacctgctccgctgttgaacaaagtgagggttgacaatgtggtgcctgattttttgtgtggatacattaatatttaatgtagacgattatagaaaattgaaattttaatattcgatcacaattgcacgtcaccttctacttctttaaccacaaaataaaaaaaacatacccaacttcgcaactattctacagctatcaatttttttttaaaaagaaaagcaatggtaatgaagcgaagaagccaatgcagttgttagttgataacaagtatgctataatatggcaaagaacccgatttctcatggtaggagtaaacatattgaaacaaaatttcattttctgagggagcaggtgaataaggggatgattgaaatcgtgtattgtccaatagaattgcaaattgttgatgtgctcactaaagcagtgaaagttgagcgatttgagaagctatgaaaggaattaagagttttacctctttgaattaaaggagggtgttagttagttagttcaaataggttagttttgttagttacatagagttggttagctagttattaactaactttgtgatgtacaatctgtataagatagagtgcttatgtgaaataaacaaaatgaatcaataaacatctacaagctttatcattctgtcttccttcttctacacaaatatttgttttctgagtgtaacccaacaaaatcaaacccaagtcccattatttagggcattgacttccaagtcaactccactagtggttctggcaacaaccttaattgggttttagatggagtagaaaaagatgttttttagacataataattgccagttaattgaggatataaaagctctaaatctcatagatcaataaaatcaaagcagtcattttacctttgtcccatctttgcctacaatgacttccaaggcaatgtaagtgatagcatcagcgtgcgtaatgaatggggtagaaatttgatactccatgaaaactaaatgatgaaattaagttcagaactaattaagtagatatatggtgccaggctgctatacaatatgtgatcttagtttcaaaacttattgatatatatctacctcttatatatgtaagttctataaaatcaaattacataaattctattactaaagtaaacattcaatgggcataaattacaaataggaattgttaacttgtttagccaaatgtcttaccatcacaacgaattattactgacggcaatgacttctcattagcagtgcagaagggttagaacctttttccatttgaatagttcttgacaaatttaatgggatgaattgacgtatatacagaaatgtccaaagtggatcacaatccaagttgctatagaatataaaactgatatatgaagacaaataggaatttttaacttctttagccctattgtcctaccatgcatcacatcgaattattaagatgatgggaagcaaatttggagatacgtattcaagcgaaatgggaaacgaagtcatgcttgtatctatatgtggaagagttttaatgacggcaacaacttctaattagcagtgcagaaggggtagaaattttattccatttgaatagtccttgacaaatttaatgagatgatttggcgtatatacagatatgtcaaaagtggttcacaatcaaagctgttatagaaaataaaactggtatatgaagacaaatatgttggaaaatggaaatgatctaccaaaatcaaagctgttaattgaactatgatacttttcagtaccgtgatttatgatatctttggactcagctcaggacttggtgagtagtatggcccaagatacattggtagtctgtagaggtaggtcattttttttttgctcaacttattgcagcactgagtgtctgagtccaacatcaattttgaaaaatctgcttatcactgacatgaaacctactgtaacattttttttgtaaagatgtccaaattctaggtagatttcattcttatcagtaaggtttagttttatcatcctgggatggggtcagggtgaatttttgtttcccaattaacatacttataagtcgcttgtttggataaacttttctataaacacttgagaaagtaaaatgaattgagttttttccataaattaaaatcaatttattcacctcaccttttggaggaacttttataaaattttgcacaagttaaaattaatatatgcaaaaagctcaattattttaagttatttttcttttctttatagaaaattttagcttaagagaacctaaacttaactagttagtatcaaccttgattatggcatagctgccaacatggacggatctgccccctcttaaattttcaagaatagataatttttttataataataaaataaaataaaaaaatagtttaaacgtttgcacaaaatgagaaattgaaaaggaaagtaaaagaataataaaaaagatgaaaaataagaggggagtgagtgtgggtatgtgtgtttgtaatttttatgaatgcagtggccacactcttgttatttttaagcaccggccacacgctaattttgtcaattttttctcttttgaattgtacatttttcacagttttattataatggtttgttcctttaattttctttaaaaaaaatttctgggacgctgtcctcgaactcccaccactggcgccccccttactttttttttttttttctggatccgccctgactgccaagtggaccaatctttttttgcctctcttggtgtctgatttgttacctccgtaacagtggcacaatttatttgttattaagcctgtttgagaccaaaaaaggtttcgtcatactttcctcccttttgaaggccgaagaagaaattataagtgggtgaagtcaccatggttacttaaaaaaaatcatgcttaaacgttagagaccaattcaatccatactctcgaaaattgaaaaggcacatagaagaaggaatttccccgccaatgatcgatccaggaaacatatttttacatgcattggaaatgatgatgtgaatattatggtttatttgttacttattggagttatcttatttaatactcaattccattaaactactgttactagtaaaacttctcgttagttatagagatcatcccactcaaggtttacaaaatgtgctctatctgaatcaagttctagttggcatgtctaagaatcaagagagagaaaaacaaagatattcaatataaaaaatcaaagaatggaaatactggggtctaccggaatgttgttattgtagggttacaaaatgaattttgtttgtttgcgacattgcgtgaggaatgggctcttgaagtcctgatgctaggaccgcaatcaaagtttaatttagctacataaaccacatctaaatttgttaatttggctataaatattcatctttcattctttatcatgtatattttccttcatagtaaatctgtgtgaacactttggagttgcacacaagttagaatggaatcatacatggggatggggtggttgtttgttgtgtgttggcatttgttgctgtttcatttttcattctcccattccttatgccatccccatgacagttttgccttgcttcacttcaaggcctcctttcccattaatacaacttattattataatgcttatgattgccctgttactaacctgaagacaacaacatgggaaaatggaatagattgctgctcttggcttggagtcacctgccaccccatctccggtcacgtgaccggcctcgacctcagctgcagtgggctttatggtgaaatccatccgaacagtaccctttttcatctttctcatctccaatcactcaacctcgctaacaatgacttctatccatctcccttgtcatctctctttggtggatttgtgagcctcacgcacctaaacttgtctaatacttactttaggggtgaaattccttcccaaatctcacacctttccaaattacaatcacttgatctctcttttccacttaattatcagtttctattaaagtggagtgaaagcacttggaagaggctgctccaaaatgcaacagttttaagggagcttgttttgaatcatacagatttgtcatcaacttcaatgaggccactcaatttgtcttcctctttgatcactctaagtcttagaggaactggattaaagggaaagttggcagatgacattctctgtttgccaaatctgcaacacttgtatctatcaggtaattttgaccttcatggccaacttccgaacttgagttgtagcacaacttctctcagtatcttacagatctcatctaatgaattccaagggccaatccctccttctttctctaaccttatacatcttactttcctggatctctcatttaacaaactcaacggttcaatcccacccttactcttagcccttccacgtctaacttttctgtatctctatggtaatcatctcactggtcaaatcccaaatgtctttcaccagtcaaacagatttgaagtattgaatttgaggaataataatatacagggtaagctgccatcaacactttcaaatcttcaacatctcatttacttggatctttcatttaacagattagagggacctctgcccaacaaaataacagggttttcaaacctaactgagttagtgttcactaacaacttactgaatgggaccattccttcttggtgtttctctttgccatcgttgatgtatttatatctagataataatcagttcacagggcatatacctgcaatctcatcatattccttgcggtctctatttttgtgctacaacaagctacagggcaatattccagaatcaattttcagtcttgtaaaccttacttacttatgtttatcatcaaacaacttcagtggtcctgtcaatttttcactcttctccaactttcaaaatctgaaaagtctttatctttcgcagttaagtcaattatccctcaactttgaatcaagtgccaattatagtttctccagcttactgcaactggacttctcttttatgagcttaacagaatttccaaaattatcaggaaaagtcccaattttgaaaatcctgaatctggccaacaacaaattgaatggaacagtgcctagttggttgcacaaaatggattctttatctgctttgatcctatcccataacatgttgacaacaccaatggaccaattctcaaggaattaccaactcacaatcctagatctaagtttcaacttactcactggcagcatctcttactcaatttgcaacgcaagttcaatggaggctctcgacttgcatcacaacaagttaacaggcattattccacaatgcctcgtgaacttaccacatcttcaagttttgaatcttcaaatgaacaaactttatggcactttgccaagtactttttcaaggaacaacaggctaagtacgctgaatctcaatgataaccaattagaaggtattttgccagaatctttgtccaactgcacactactggaggttttaaatcttggcaacaatcaaatagaggatacatttccccgttggcttcaaaaactaccacatttgaaagtattggttttgcgggccaacaagtttcacggtctcattgccagttttaaggccaaccatggatttcccagtttaattgtttttgatatctcatccaacaacttcagcggcccaataccaaaagcctacatacaaaattttgaagccatgaagaatatcattcaagatgaagtggatagcagttcacagcaatacatgcaaacgcaatttagtcttggaacatacgcttcgtctgtgactgtaacaatgaaaggcatgagtatgccacttacaaaaattccaacaaactttgtaagcattgatttatcaggaaacaaatttgaaggagagattccaaatgttattggagagcttcatgcactcaaagggctcaacctttcccataacagacttagtggtcttattccccaatccatgggaaatttgacaaacttggaatcattggatctctcttcaaatatgctcaatggtaggatacctacagaattaaccaatctgaactttctctccttccttaatctttcccataactatcttgtgggagaaatacctcaaggaaaacagttcaatactttttcaaatgattcctatgagggaaacttggggttatgtggagtcccattgtcaaggaaatgcagtaaggaccctgaacaaaattctcctccaccttcacagaccctttggagagaagagaaatttggatttggttggcaaccagtggccataggatatggatgtggaatggtatttggagtgggcatgggatgctttgtgttgttaataggaaagcctcaatggattgtgagaaaggttggaccttaacttaatcagaaggtgaaaaggaacacgttgtataagactcatggaagaataaatcagctcaagctgctgtcatagttaatgcgttttcttttcctctgtttttattgtcgtgaatttgtaaaactatttctaagatatataaatctagcaagtttgtgctcagtgtacatatattaaaatagttgaatgtgtattcacgattgatgttgtaatttaattataaagtatcgtcttaattatttttaataattatttttaaaattaataaatttatatatataataaattgtgattagatgattatataaaaaaattatattgtaaatgtaggtttaaagtcatctctgttatataaatttaaattttacttaacagtaatttttcatttatttactaattgaatgcttaataaagtatgttaattaattgatcccattttgtttatgcgcaatatttattttgtgtgaatgataccaatctcattaattatttcgttaacatgtttatttttattaacagcaaataatatttcataaatgatcatttatactgacgtttttaacgatgccaacaccattttataaggtaaacactctcaaatctcattggtccatctccctcgttcttcctttgaaatgcatttttaggtcacacatgttcatatttaacttgttctgtttttccatgtttgtatcggaagaacttgctattttgtaggaaaaataacacaaatcaaataaaaatcaaatgttataaaatggaatgctattaagaaaacaaagtttaaatctagaatattatctacacattgaatttatgcttctagaaaatttatatttctatataaaaaatatagaattggttttttcaatctctatatactttactgtttattattattttgttttggttataaaatattaatatgaaatatcaatattataaattactatttacttttttttattaaagagtttaggtgagttgaattatgaggcaaaaaaaattagattcaatttggacatctaaaatgaaattcaagcttgatgaaagtttaatttccaggacttttaatgtcttaacctaaattagaacatgattgaattgagttaaaaagatccaatttaatttataatcaaagtttaaagcacaagtccacatttcatcaaattagttctatcatgttgatacctaacctatttttatcacctttattcattgtttgtattaggagttaaatagagagagaaaataacaaggataaaaataaaaagcaaaataggatataaaagatatattgtttggatgaatattacaagtgaatctaactataaaataacacttaaaaatatttttatgttataaattttatttatttattttaaaaaaaaaagtttcatgcctacatatgaaccaattttatctctagggatggaaacaattttctcgtaggatccaaaaaaagttctttacttcccttttattgaatgatgaagaaacatcttctaaaagaaacaaaaatgacaaacaagcatagaaagttaataagttccattttctccttaattcgttgtatcctatttcgccttaaacaagcaataggttaatgaaaagtgaaggagaaacattaaagactaatttattggtaattttgaaaaatattttatagaaaaatgtataataaatgatttatatattttaagaataaaaatagatatattaaaaaattaaaacataataataataataataataatttgattaggtattcataaagaaaaatttattaaaaatcaaaaaataaaattcactaatttatcatccacctaaaatatatttaagaaaaaaattgaaatagttgaatataaaatataaaattgaaaataaaatacaacccacttgttgcgccgaacctgggatctggcaagtaggatctaccaagtcctaccaatgcacgcgccacctcttccagtttccacgattcccttcaaaaccctaattttactccaattctccgtttcacatttgcaatttttgattcccagacacccaaaatataaattatttggtgcatatacgtttttttttctttttttcttttttgatgttccccttcctgtgttgcataacacaacctattcttttaccactctgtgatacccatttgattactaagcaaaatacaactactctctcagtttaattgagttcatttacagttctttgcatcaaattttgattttgaattggtgggtgtttttcttctgttatgagtgatgatggcactcgaatcttgggttctcagtcaccaagtgttcacctccagttccagattgttttgccctgcgcatgagaataggcgaaagagcttaccaatcaaagttttgggtagaaccactagatacccatttccctttgtgcccaattgtgttgctccatctacttttacaatgcttcaggcttcaagttttggagcagatgccaagttactagatagaactcggttgaggtgtttaggtagtagccgcaattgtttgagcgatagaaatgccgtttccaaagccaatttgaactttatacaggaattgttaaagaggggaatcatcctggctgcaactgtttgtggggtattggtgtttggatgttcacgagtttttgccgttgaaggggttgtgaatgcaggatatggtgtttttggacagagcattcttttgcttaggaatacatggcctaaagtgttgcaagttctttgtatatttaaggagcaaggtttggtgttggcagtgcttttgggcctttcagcttttttctcgatggcagagacttcaatcactacactttggccttggaaggtatctatcttgtttatgttatcctcctttttctgaatgataatttatgttacatgaaagtaggagctatgcctaggcaaaaaaaaactctttttacaccgccattattcagtatagacctattaaataattatatggaagttgaccaaaggattgttgccagccttgattggatggggacattgctgacagtgaaatttgttttgatatccaattgctgaaagtttatcaattttgaagaaatgaagtttggatcttgcatgagatcatactgaccagaaattcatctgccatctacctgagtgcaacaccaagatttcttgtgctaattatgcagaatttatgaatgactaaaagttagggatttcataactgatgtatatgttagtaaggaaattaaatgctgtgatttaaggatcaactactagtctattatatttccttttcttttcaaaaatgttttttgttcttttaacatgcttgcagattttgcacatcagatttgttattcactatgattaatttagctgattaaagtttgaacattgaattctaatatctgttgatgacaatgtgtaaggttcgtgagttggccgaaaaggagtctgaaaatggtgtcttcagactactccgaagtgatgttactcggttccttacaacaatacttattggcacaacgtattctcctggcattgatcttattattgaaaaatgtcctattttttttcagtgtagaatgtttctcatgctagtattttgttgtatgcagggtggtcaatattggggcaactgctctggtcactgaagcagcaactgctatgtttggtgaagctggtgtcagtgcagcaacaggagtgatgactgtatgttttgattttcttgctcaaatgttaaaaaaaatctactgtttctaggacatcaaaacatgcttaaagggcttatgcattgatttgattatctaaaattcagatgcactaggccacttgattattattcatttggaacattgaatctttcagtatatcaacatgctgcccattaaacttgcaaactcctgatgtgttgggaacaagaattttacatgtaaagcttgctagctttatcaccaatttgtgaaaaaggtgccttagctaacttttgagtaagatagaagaaaagagggggggggggggggggggggatccgttatttgaatttgtacatttaaaagctgtccatagacagaagtttagacaacattataggatatacctgtcttattttatgttatatttttcgttgttttgttataggatttacaatagaattataaattatcttttcaatcagatagattgcatcaaattgatcacaaaacagtgcatatggtgtgcaagtttgtatgctttcatgtaagttttttctcatatatctgatttctcttttctctttgtaatcaaacaaggttgccattttgcttctcactgaaatcactccaaaaagtatagctgttcataatgccacagaagtggctcggtttgtggtaagttgtaaatttcttgcctgttcttttataatatttgggaacagaaatgatgctgctgattagtcatttttgtttactttttcacacatcatccatatttacatgatatttctgcctcaacttcttttgtaacaaatattgatattgatattgatcctaatgcctctaggtcaggccagtggcatggctttccctggtgttgtatcctgtaggaagaattgttacttatctttcaatggggatgctgaaattgcttggcctaaaaggaataaggtctgttgaaaagattgccagagattaatcttcttttatcatattatatctatttcttttgcttctttatagatgttttgtgaaatctaattttaatctgatactaactaaatcttagttccttcatcttaaggatggtgctcttttattttcacccatgctccatgataactgttcatttcctaaggttgattttttcctaaatgttatgataaagagaacaaatggggaaatgagattattttattaattatgagggatttatatgtggtagatggttgataacagttcttctgttttttggtttctaatttggtcgaatgatgtagcacaaggcagtaactgttttttttccttccctttatgtaatgttgaaccctggtttgaaagagcaactgtggtttgccaacttagtatgtaaatcatgtggaaagtggcatccgtttgttgaagcaatggttgttggacatattctcgttgatttttttgaaattcaacactgaagtcattgcttactttaccagtgagccatatgtaactgaagatgagctaaaattgatgctaagaggtgcagaattaagtggggcaatagaggaggaagaacaggtaatgaatattgggtttaatattctaataatatcactatatatttgtcttcaaaatgtttagccttttctgtcatttatagaaaacaaaaattcctttttataaagatttccaaacatcaatattgtttattgtaataaaaatactaaattagtttaaaaaaacgaactaatgtttttgaaaaaaaatatattattgagtcatatgaattaaaaaaagtttctttttcactaggaatttcgttattggtccgttttaagtttatactttgtaatgtttgaaaaaaccgctagaactactcttttaaggaaaaaatatagaaattaataattcgaaatccatttttgaattgagatttgaattaaacattgattgatgttttcttcgaaaattacgacaattcaatttgagtttttatgttgtaaggaaaaagataataggtaacaagtaataattttgtttattttgataacatttgaaatgaaatattgtattacggtttttataaaaaaaaactttttttccaatacaagcaagctaggggaaaggagtcttgagacttgcatttaattctaaattctatgcatcaataggtttgttctaaaaaatgttgtatgtaaatattttcgtctcggattccagtagtgaaaaggaaatcaataaattagcataaataaattttcaatttttcgtatggaaatgagcccccatcatattttctaataatgatgtatgttactctattgtcatgcttctttataacacttgcaaaagccttatcttcattgattgttgtagatattttaatccacttttatgtctgttaaaatttaagcatctcacatatatataatatattacaggatatgattgaaaatgtgttagagataaaagacacacatgtcagagaggttatgacacctcttgttgatgttgttgcaattgatgcaagttcaagcctggtagactttcatcacttgtgggtcacacatcagtactcaaggtatttgaagatttcctgatttcaaatttacagtgattttacttttccaatgtgctaactagatcttgacgtgtttcctagagtacctgtttttgagcaacgtgttgataatataatgggtatcgcatatgcaatggatctgctggattatgttcaaaaggttaggagattttactcatcatgtttattgagttacaagtgctttacttattaattatatatcccccaatctcatagtctgtagaattatgatctgtttgattttgaagggtgagttgctagaaagtactacagttggagatatggctcacaagcctgcttattttgtacctggtaactttttttcatcattcatcttgagattacctatgttcacccgtattcatgcaatgcaatgtagccacagtacatataaaacattatttattttacctgatgattataattgggccagctatgctaggtgaggaacaacaaaaaagcagcaatactctattagatctattgtcagactttttttacatttagcattttgttaatctaaattgctggtgaattaaagcaagtcttttattcacccattgcattgtcatctttgctgtgttgattgtgttgctccatatatttcagtgcattttcagaatagattctggaggctctgaattgtcattctgaccaattcagcatttcttttaaaatttaaaaatgctaatatgctatctttgcttcatcaagatatctttttttcattgataaatttcgcaatatctttaattccctgtcataaacttataatataaacacaccaattggaagggtagcaggggaatgttcaacaatttggctttctgtcatgtgctagtattttatgatgaattattccttaatgtatggacaaagaattaagcagcagctgacttgctatgtcttgactgaacttaatgatcacaatccctgattttctcctcctattgaaattgaattgttaaactggttgatttgtctgggataggaatacatttatatcttttaacttggtgcagaatgttaataaattattattacgatttgcagattcaatgtctgtttggaatcttcttagagagttcagaatcaggaaggttcacatggcggttgttcttaatgagtatggtggaactgtgggggtatgtgcacaccagtccagaatacaaccaactcggatctttttgtctgacataaatgtgaatataaatctgtaaatttatgattcactggtgatatatacactgctaattacaaccattgacccaaaaagaagtatatgaaagatatcaatttgaacatgctattcctattcgtttagtttctttcaaaatcttttccaattatttatcaacctcttttttatgctaatttgaaatcaaagcaaacagaatcaacattgagatcattcccgtcatcatgaactattgcaagaatattcataaataatcctgtagaaatattagtttttatacatgtctaactgtgctacagctgtactcttgtaatatgttgtaccatactgtgtcttgtgctataatataatttaattattttttctcttactttacagatccaaaatcattgtaataaaaccaaaagtctttctggttacaaggcaggctattctgatttctaaatgttcttatttacccactattctcatcttccacttgcctttatctttccttgttcttgttacaattaagtttgaatatctaatggcagtgtttcttggattctgagttcgtttttaaatgattttatggtccacccttccacacacctgttgcatttagcaaagactgggtgtagacataaatcgcttttattgatagctaaatcgagagagaaggtttagttcttcgaacagtttattagattgtaacttgactctccaagtcttctgaaatccattccatataatctgcttataagttctaacaattttcagtttatcaaatatagatgccttattgatatttccatctaacagattgtaactctcgaagatgttgttgaggaaattgttggtgaaatctttgatgaaaatgactcaaaggtaaatgcttgtgcttaatctttactttgtttcttttaaatatatttttaaataactgaaagtgaagcatatattgaattccttcatctttactctgtttcaccaaaaaaaagaaacaaaggatcctttttattctgcactctttgtccaacaacagttttgtatggaatatttatttgtgctgactgcataatctttgtatacctttctcagttatttttattgtcttataactatcaacaatttagatgctgacaaatctactgtttaatggctactagtggtgctttgctaaaagcccagcttgtgttttaggctatctattttcatggcttcagattgctataattcaaagcagttaaaaaatttcacgttttttcaagtaatacaacatgaacgaactttatataaattaacagaatttacagaagtaaagaaagaggtcaaactattgagatggatccgtgtttatttgaggaatgatgggtttatgatgttatttcataactaggaagtcttgtttggtaaaaataaataaaagtaaataaattgttcttggccatattcaatgttcaaatacaaactctccaaagcatcatagtgtaaatttgtgagtacgaaattaaagtaaatgagagggtaaccagtaatgatgtgtaaacgtgataataatgcatataagtgcaagaagggttctgggaagatgtcaagatagaattcaactttgttagcaaaacagagatcagtatacaatttaagctaggtttgattctgaggttgctagtaattctacacataatttctgggtaactgataaactaactcagactgaagatagaaaatgatttgtatgctgaataataacctttttgataaacaaaatgcagcaaaaacatctgttttgggagttgtaagtggtcactctagatttgattgtgttaaataatttcatttagtatagtattcgtgtcaggatgccctcagtaggcagagtgcaagttctgccaggaagaaaaaacaaaattatacattttgttcaattctatcattcctataagtttagtgtacattgcttactcttaatgtttaactgttcaagtcattgtctctaacagcagtaggacattaatgcactttgaatttagctattatcgcctaattatgcatttgattgttgatgactataactatttgtttgctaatttttcattaaagaaagtttttacattctgtcctggtgattcctacaggaggagatacagaaaaaaactggctacatagtaatgcgagctgagggtgtttttgatgtggatgcaaacacttccattgatcagctctctgaagatttgaacatcaagatgccagaggtttagccccttttttacatgcaactgacatatttgtcttctcatgaccctgcttatttgactggagctagtgtgactttcttagttgcactatctagtcagtttatccttaaaaggggaaaaaatccaagatcacaattagtagtatagcaataattaagttgttcatgaatttgccattcagagtcattgtagacccatctttgcatctcaaataggcatccgctccattggatttcaaataggcatcatgccaacacatttcttatgctagcttgttatttctacacaagttgtggactaaattgggaaaatttgcaaactgcattatatttttggagaaatttatgctgataacaattgggtttcatgaatcctggggtttagatttgagttgacagcattgcaaaaaatccaagtcccacatcgactaaagataaaacaagatagagtatataagtgaagggcaaccctcaccccttgagctagttttgggggttgagttaggcctaaactcatattctaagaatctaagatggtatcagagcatatccaagatttcattcaaagggtcacccaccatgttatccatgcaccaaactcaaaagtgctaggcgtgagggggtgtattgaaaaaaattcaagtcccacgtcaactaaagataaagccaagatagagtccctcaccccttaagctctaattgataaacgaagcatcgtaaggatccattaacgcggttttgaaccgatacaaaactcacattctaagaatataagagacaaacaatgatctcattggaattaattttgcttacaattcatattgctaagtctgatgaagaatttcaggcctcctgatacgtaggtgacatctatttcagggtcaccaatatgagacggtatcaggctttgtgtgtgaagcatttggatacattccaagaacaggtgagtgcatcaaagtagttcttgaaagggaagatgaagatgataacaatgagtccaatgctgaccagcaggatcagaaggagaagaaccagattttcaaacttgaggtaatcaatctgttgctatcttaaattgccactcaagatagtcctattgatttttgcatatacagtccaaagttgaagagaatgaatggttagcactttgcacataaattacatcagcaagtataatgatagcataacacaactacagcatacttgcataagttgcatgtaccactttttagttttattactctacggttactcaagctacactaaagatgtcaatgtgattttcctcaaaaagcttgttcaacaagtttgtgctttgatttctggtttttgagcatatggttagtcattagtgaagcaatgtcagaggactcggtatattgtaccctatcaattctacagcttttccattttgtagggttctatgttgtcacgagattggaattatattttgcataatccttgctattttttaacttgtgtgagccacatttatagggtttcaaattaaaatgtttttatttttggcaatctgtatgaagtaataaactgaatctagaacttctccttagcctcccccatcccctttgtctttggaatagaaaacacgcagcttctttgtctttggtgcagatactagctggaaatgccagaaaggtgagcgctgttcggtttgaacgcataaataataatgatgaaatgttggagactaaagtaactcgcatggtccccaaaatcatgaaaagaaaatggagcagtgatgagaactcggacaatgatgcagaatatgacggagatacatttgcaaagagaccacaggatgacattcctagtgaatatttagttgatcaggaaaattctaacagaggttaagtttgttcgttcttcatatttttctcctttctttatacctggcatgcttttgtgccatttttgcaacagcctataagatggataaattatgatacatgtacaaaatgagaagcaatgagttcaagcatgtaaaaccttgcaaaagacgaattagaggagtctttgctaacgaaagtctttaaggctttggtgtaataaagatgtcaggtttttcaggtttgatcaaaacaatgaccattttttccaaccccctctcatacacacacacacactagcttagcactgctgaaacacagaaatttacttgtgtttcttcacaaatttaatggaattaattagaaacaactttcacttcctatcactgggaaagaatctgtcaccagattaaccagttggaaatagatgtttttatctctaccccaaattttaatccttatcaattaatgaacttcaaaattgtactttattcaatactattttactcttctttttttgaagtaatcctatttcactcttaactcccgcttgtaattctttatttataaaatattcaaggaacacatttttgtataaaaatatattataaaatagcattcttttttcattatgatgttatttgtttgaatatttttattttaaaagtaaatttgaaacggaacttaatataaaattcttaagataacgtagtcaaatgtacctttagggggcaaacagatcgagccaggaaacaacaaccaaacatgttttttttccacaaaaatttgtttgacacctttaaaagcaaatttaggcagtatgaaaggttcttagtgtttgaatttgtagatatgtaccatgattgttgtttcaatgttttcctcaaaatgtataaatgtgtacaagcatagtgaattttacttctctaatttttatttacctttaaatatgtgtgcgtttttaaattaaattggaagaagacataatttaattcccttgctattgatgctcgagctataaaaatcgttgttcttggtaagtggagaaaagaaaagagaaaggaaaacagaagaaactacaactgagggaattgaacttaaccctccacggcataagctatcaattcattccacggcataagctatctattattatcatgatttttaccaccattattactaccaattgtgatatttttagatgtgataattgagatttaatttttacatattttttttttattttatgaatcttttagagatatggggttacataaaatttaattaaaaatttaatctcaatgttatattatttttaatcttgacataatgattattattagttattattatgttctcacttaacgaagtgcgttcacttgagtcggactatgtaaacagtttcattaaaatacatgtttaataaattcttatcaaatgaaaactttaaaatttaattttgaaatatactaaaattagttaaaagaaagacttatttaatttgatgaagtttacatataatatgttaaaataaattataaatatattataaagagatcacaaatatatttttttatataaattcaaatgaattatcccatatatttccatcatcatgaacaatttgaacaataaaacaatattaataatgggataatatatagatcgtgatagactaattaaaatttgacagtttagtttaaaaagattgtgcaacggatcgagattctacatcaggaaatgcatgttttctaaaagattcaaattaacataattgttatacaagttaaacaaacagatcataaaaaaatgctacttactctcatggggtacatcaaatttctacaaaatcaaacatacatggatacaattttatttaataattaatttaggaaaatattatcaaataaatcactttctaaccccacatatgaatattagaaataacacatatatcacacactataactagatgacgatacaaattcagattctaagttcacaagaatacgaattgaaagatggaatcataaccaataacatgcacgcatggctagccgatgaagttgtgaactctcttcaatcttcatgcatccttggccacaccttcttcctcaaacatgctgccaccacagctgcatctactacttctcccaaaaagaattaattaagccatgcatgtgttgtacaaataattaatactgataatttaggccatatttaatttaatttgtcactgaaataaaataaaaatgattttcgataaacataccatctgccatcgtgcatatggtcataatcttcttgtttcacttctcacagtggagtggtacggtacctcaattacgatcttttgcagcaccataataataagtagaacatttcataattaacaaccttatgtgtacatgtatatcaagaattagctgaaacttatacagaatcatcaaaacagaacgttaaattctggaattgtagataagtcaacttgaaactttcttgacccagagaaagaaaaaaaaaactgaaattcaatgagttaagcaagttgtttaccctcagtcataagtcatattctcctcaaattagtgaaagagcttaattaagttcagtttcttcttaattagaagtacgatgatccaccatcagacacacatgtgtatatatataaagtatgtgttcaactaattaacttgctacattggcgcgatcttatggattcaacgcggttgccataccgcattatcaaaccaaaaataagtcaacctgattatgttaaaaatcattattgaatcacgtggatggagatgcataattttattttatttttaaaaaaaatgctttctttccgtgaaatatgaatatttaataaattataaaaatcttttaattgccatgaacaaattaagatgtaattttttttctttttcttttgtaattttcagcagtacatttatctgttaccactcacgacccaagaatacattctgataacgttattctcttttttttttaaatgtaatacgacgatgacactgttaccgaagtcatcattttatcaattgattatgtcattacggaatctgacttgtaagttgtaacgtgttgtgatcgtctgagaaccatgcgtgggactcgtgcatgcaacccttcttgataggagtgtttgtagtttggattggattggttttgaagtaaaaaattatccgatccaatctttttagtttggtcatttaatcatttattcagtttgaattttttccatccaatccaatctaatttttttcggtttggattggatcgatctttgattttttaaaaaaatttaaaaataaaacttatgagacttatttttatcaaaataaggagtatctaggataaaaaagcacatttattgaacaaaaataaatatcattttctaatttttattggacaaacatatttattggacaaaataaggaacaatgtattgggtttttgatttttgggctatgatagggaataggcccaagtaggtaaaaggtaaggtaaggtttataattggatcggtttggattggatcggttttcaccaattaaaccgaaaaccaatttaatccagtaaaaaatttcgattttttagattttcagtttttcgatttttcagtttttcggttattttggttatgaatttttcgattcggtcaccgtggtttagatcggttgatgaacacccctactccttgatagtatcttaattacaaattcatcattcaaaagtcaaaactttattcacaagtattttctatttcttttaagatagaataatggacatttggatattacgtacgctaaacatgtgacttatagatgtatttttaaaaggaaactatatactgttaataagtcaattcaatagctgataaaaaaatcaattcaataaagaaagaattcaattttcatatataaagttaatgtaaaaaaatgaatttgtctgattgactaaagtaaaaatgagattaactcatcttgaataactaatagaatttagataattatcttaatataaaattttatcattaatgttaactaccacatttaatacatcatctttaatttttttatatcatttatgtataaataaaaactttatatttgttaattaaaagctaataattattttataattcactttaagtaaatagttattataaaaaaataaaatttaggaaaatagtttcattattttacaacttcaaagtataataccttaaacaattttccatcattttcattataacttttaattaaaaattatagataaagagtataaattttattaaaagttatagataaaaattataaaattaaaattacagccatacatatttttcctaaggtgaataaagaatataaaaattaaaaaacaattattaagattttattattttataattttattacatatatatttatgtattttattataattttaattatcaaattttaattttacacataaattatataaacaaattaaagatggaacattaaatgtgatattcatagcattggttaaattcaaagtaagataattatctaaattatattgattattgaatataagattgtttaactccatttttaattgcggtcaattagaaaaatccatagaaaaattatacaatcaattaatcattaattattttatatattgtttgcaaaaattaataaactttttctaaaaggacaaaacaaatcaataaacttaacatatacagcgattatgtaatttgatcacaatgtaaaaaaaaatatgtaaacttacaaataaatttatatatatacatacatatacatatatatatatatatatatatatacacacgtatgtgtgtgtgacttttattaaaaatagtttatatgtgcattatttaattcgacacaaatatcttataacagaacgcgtatcatatgtaaattgataatttgattatcagtgtgaaagatttgtgcgtggattaattgactaaaatatgcaaagccaactgaggacagatggaacgaatctaattaagtaagaccatactaattaaattattaattaatgtcaataattgagggagcctgatatttttttatactaagattaaatataggtttataataattcatataataagttcaactaattgagttaatttttttggctgagggagtatgatatcttcatagagtgcatgaaaatcatttaatttaaatttatttaaaattatgattaaaaacttatacatttctgtaaaaaaaaaaaaaacttattaataagtactgtaaaataaaaatttgagcgtcaaatgtcaataattccttaatgatgaattaacatttaaatataaatataaatagaaaaaatatgggtgttgttgacttctgaaactaatattttatctggtcacaccacaggggcgcaaccttatgtggcaacggttctcttcttcgatccctttcttgcacgtgttgttaatcttacatgttatgctccctcttcagcctttacacttcgtttttaggtcagaaatctattaaaacagggagtcacaacttcacaggaattatatgtctaacttttcattctaacaaggagatatatactatgcattagaattcatttttcaatatttcttttgtttatataataaaaactcagtataactaacctctaaaattctcaggatgagtctgcagactacaagtgacaaatcaacttattttactcatgcttaatttattggtatgccttttgtttcacacaatattaggtgaacaaaacaaatatgtagacccaaatagatagatgttcatgtactaaaaatatccatagacactcatgtattgtcaatctatacggatatacctaaagaaagaaaagtatagatatgatatgagatgttacgtgacaagaaaaaaagataaagagaaataaagagtttcaatcaaatatttacagtgagtgagtgtttacatatctatattctacatatgcaacatgttactatcctagcatgcatactaaataggcaatacaaaaagcttaaattttattgaatttactttagattaaaaaccctctcgtgacttaattttttattttttagttttaagcattattttttttatatatttttaacacatgatttaaattttggatattttaatgattttaaaatatgtcttaggtcacgtaatcttcgtcctgcgttaaaattaacgtagctcgcgtaagtgttgaatgcctggctagcagggcgtgacctacaacccactttgagattgggtttgaactttgaacagaaagactaacctgttttttatgcagcccaaaatggtcctaaaatattatcatctatagtccacaccatcgtaaaaaaaatgaaatactaaagagaaaaaacttagagaaatcaaataatataaaatgaatgtaccaaaaagtcattgtccgattgattctagattcaatcctctaaagtaaggtatcagtttaagtctgtttatgaaaagaaaaaaaaattgtaattgagaagagaaatttcactaaaagtgatcagtcaggtttttgacgtaaattaatcaccgataaatttaacaaatacttcacaccagtaacatattatccaagaaatataaaatgaatgtgatagagattttttttaatcctctcccgtggttttaatcagttttgggcttaattttgcaagataagctgtaatccaagaaaagagaaacccaaacacacaattaggtgttgtggttttctagtctagctacaattaatttgcatcctaattaactgctccatttgcggatcttgggatttattccagaaaaatgggtgcaattcagctgtaaccttagtgacatatatacacatcatgacaagaagattcattcaagagagtcactctccctttattggcatgcattttaatttctttcattcataattccctcttttaagttgacatacttggtcacttattcggtgctatcatggtagtgaaaaatctgacaacgacaacgctggaaaaagtaccatgtgatcaaaagccaaagtacaatacacgaaattctttgaataaaattccttacgaacctacaaacttgattggatcagtatgaacatttatgcattatttgaatcctaaaaatgttcactacacgcacattatacatcactggcagcacgtgtttttggaccacttttccaaaatatttgagtcaagtagacaaggttggccataggtatacgtagcttgtgtatgaagagtgggtgtgtttgaaacattggggcggggaaaggttgtgacgtaacggaaccattaatatgtatgtaccgttaatgtctctcatcttgtttgcaaccacatttatgtagtattgctgttaaagaagtagtagaatttttcttttttctttttttggtcttcgaagaaatcactaaagactcgttcaaataaaagtagacaaagtagacaataaggatatagtgatggcaactttacagagataataacgactactgctacgacctttatctttctaatgaaaatagtaaaaaaatacttaaagcaattaagatggcaagatattcatataattttgacaaatttatattatgagatattataattgcacaactctaattatacaaattgtgttttgaagatacaactcacccgaaaattaaaatatttccttaagccactctttattttctctctctactccactctttattttctctctctactctatatatttcgtcacatttagactatataacatcattatcattagatctctcccttattaagcttttacatacccacattaaacatatagcttactagagtgtcttagtatttgcaagtcaccactcatttctctctaaacaattattcaactcctccatcactaaattgttgaagcactctccaatccaccgcaattataaatccctctgacccattatattcccactgattatgttggattatcatcgataagttcaatttcttccattaaatctagaaaaaagttatgccatcccataaagaaagctaaatggataacaacattataaagaatattatcaaagctaacgcactatatatcaagctaaacaaaataaacttgttataattgaaaagaatattcaggcgactttgtagaacaaactcacgattatatttgacaagtaaaacacttgatctctatataaaaattaagcgtctctttggagcggtaatgatttttaatacatttttttatatatttttttcactttttttaaactaagaaaaacttttagtgaatttgatttttaatttaaaaacaaaacacacatttttcacatttgtaaatgacactttttgttgtcaataccactatcactattgtcatggattgctattgccaccgctaccattattaccattgttgtcactactataattgactatcaccaccacgatcactaacaatattatcatcattatcattgtcaccatcgtcgctaccaacattattaccaccaccactaccaatgtcatcattacaactactatcattgtcaccaccaccaccactaccatatccgtcatcgtaccgccaccaccctcaccaccaatgttgtcgcaaccactaccatcatcaccacttgttgccaatttaaatttcacaattcaacaccaccactatcctaccaacatcattgccgccaccacatatgtcatcgccactaccaccaacatcaatgtcattgccactcttatcgtcattgtcactacctccatcattgtatggtcaccaccccatcatcaacgttgctgcaaccaccaccaccaccacatcgtcaccactcactgccaccaccaacaccgctatcatcaccgacaccattgacatttctactactactttcgttgtcactaccactaataccattttcgttatcgttgttgtcaccaccaatactactatcaccaccatgttgtcattgccaatcttccaccacgaccaatgtcacctttaccaccaccaccaccatcgtcaccaccattggtactgccatcatgacctggtatcgttatcgtcaccaacatcattattgtcgtcaccaccatacaaaaacattcttaaattaattttaatatgataagaaatattttaaatgaaattatttgaaactagttatattttaagaactgatttaattttttaaaaaactaaaactaaaaattgattgtaattttttaaaaaaattgaaactcaaaactaaaaatcatcttaatagtacctaaataacctaattatacttttggtcaaatattttagggatacgggattttgatttctttagttttaattattcactttcagatttttttattattgaaattaagtgtctttacctcaaaatcatatctattaatttacataaatgtatcaattcaaaggtatgacgtataattgatttatataaaacaaaaaatattaaatttttaaacaacaaataaattgtacacaaactatttatttattttcacttaattattttatatatttttcttgtacaaatcagctatagatcacactcatatcacatttgtatgaaatattaaatgaaaatttagaataataaacctattcaaacaattagaaaactataaaaattaaatacgaaaaattaaaattagaaaactaaaatcatacatacataaactaaaaatggaagaactaaaatcacaattaagcctaacaaaaaccacttcgatcgagcattggccacaaatcaaggtttgagtttgaccacccgaaaggataagattatggaattgttgcctttcatttgatacccctccctgaggtagggtctaactaagtatataacgaatataaaaatgaagtgccaaatctgcatggacaagatcataaaataaaactcttggggatgttgtgggctctcccagaaattcgaggggcctccgtttagcatgacaaagaacacaactcaatgagtgtgctgtgtgcatacatggtgtggacctttcagcaattggctgtgtgatattgatttatttatgaactttttttatatttaaagaagatgtggcattgtcctatctatggttgtgtgtgttccctcccaaacaaattgaaatgtaaaatgtttgttccattctttcaccacaagtccacaaccaaccctttaatccttagcctctttccaaggcctgtattttccctcccttggtccccgctttacaagatttgagtttctgaatctcaaggatcttatgcaatggcacccattcaacttgggtccatatctttatctattttttaattccttaatgatttttttttttcaatttaatgatcattaaattaaaaatcaaagaaaactaaactctaactatagagaaaaaaaaaaaaaaaaacccaccttgtgtgactcaaaacttaggagacaggcatgacaaaaattgccgaacttgttgtgcagttgaagagttgaagtactaaattcagcatgttggattttccaaattattattatttttttttttggaaaaaaaaaagatggtgattctagtaggcttttttaccatatgaatgttttttttctcttaattactaaatggaataaatcgtgtcatgtgatatgatttttttttttcctttttttttattttcactaagaagtcatgccatgacatctgaatgcatattttaaaaaaaaaaaaatagaagtcatattacttagtatgatttatcttatttgataatttttttaaaactcactctaataagacaaaaaaaaagtccccactatgaaaaagccgaattctagtaattggggtagttccaagctcgaatattaagcaaaatattttgcctaagtatctgactattcaacatccgtgattttctagaaagttttaaattttaaaggaaaaaataaaaactgcagtcactactttaatataaagtgtgtagaggtcactatatttgattttgcaaaaaaaaaaaaaaaaagagagagagaaccataaatggtgtctttgctactacttggattctgagtcttttcaaaaagcatcactctgtttatttttggattaggatgtcacagctctctgaatgtaagtgaaggttattgtactgggagaaaaagtttgatgtggaatgagcaaaagttgaaaaaagtttcattcttgaaacatttgcagcattgtgtatatcctgttattcgatgggtatattgcttttgaagattttgtttttatttgtttgcttttttttattctctggacttggaaaaagtttgacctggaatgaggaaaagttgaaaaagtttctttcttagaaacatttgcagcactgtttatctccttctctttgatggatatgcaccttttgaagatttgattacctgataataagatgactgctatagagaataactataataaaaaataagataagatgtatattatattaactattatagataattattcaaaataatcttatactagacatatcttatataataacaactattcgttaagaaatctatcttatcaaatcctatatattttatctaattaacaactattcaaactgaaagtctaatattttctataattttgtttttaattatttgttcttttttaattctttctgggtagaaaaagtttggtgcggaaagaaagttgaaaaagtttcattcttgaaacatttgcaacactgtttatctcctgatctttgatgggtatgcagcttttgaagattttgtttttatttatttgttcttttttttattctttggggttagaaaaagtttggtgtgcattgagcaaaaattaaaaaagttccattcttgaaacatttacagcactatttatttcttgctctttgatgagtatgcagcttttgaagattttgtttttatttatttgttctttttttattctttggggtttacacagtcgtttgagattataccaacttttctttgttttgcaaaaaaaaaaaattggacctttagtcaccaatgttgaaatgtcagtgcccggtttttaatttgcaaatgctgattcgttttcttgtaaccatttgttctgttgcgactttctaatggtgtgtgtgattaatgcatgtggatatttctgagcgtgtttcgtactcgtttccatattaggagcaagacccatttctgggctgcattaaagttacttcctttttgggtgatgacagagaaaattgaggaaaatataatgcactgtggagtgttttcctattctaagacttaatcactgttcctgtattgctaggtttttttataatatttgattcttggaatagggcgcctttttgcacgagaacatcacctttttttttttttttttttgtttctgttggatttgtggaattacttcctcagaatttgtacacttttttttttggttttggttgtttagtcaattgttatggtatattaggttttcaattttgttttgtaagattgggactctggtttttttgtaccctatatatgtcttgtgctgaatctttgtgatgtggttttgttgtgtttctttgtgcttgttttgtgagcagtattcactaaattttgtttacgcgggctggactttttgcagtaacaagagaagagttatgtattctccatacacaagtatagtcttttataaaattcagaaatttgagccagagaatgctagaaagataattgattatatcttctttcaaggccatggagaacaagaaatggctaaactggcttcataccctgactatttcatccgtgaagtggcagttcaggccagaaaggaactccaaagattggatgctaaaccagatatgctcgcaatgtcacgtactgtaaaccctcagcaaggtttaagtgatttatcagtaatctcccctagaactcctacttcaccaaactttcaagtgcctcctccctattgggatccacaatctgctggcaacgtcaatccaaactttatgggaacgaattacttggattctattgtagaacttcagaagcagacacagatgctcactctggagaatcaaatagatgctgtaaaaactggaactggagggattgccaatgattactatggcttagatgcttctgctgccaatttgggtggaaaagctgggagaaggttttctgaaccaatgaagatatgtcactatttcaacaaaggattctgtaagcatggaacttgctgcagattctatcatgggcaagttgtccctgagaaattctctcagatgtatggaaatgatgatattagtgaggatcaggtgatttccccggggtcactggcacagttagagtctgaaattattgagctcctaagaacaaaaggcggtccaatgtcaattgcttccctgccaatggcatactacgataaatataaaaaggtactgcaagcagatggttatttaaccgagagccagcggcatggtaagtctggctatagtttgacaaagcttcttgcacgactgaacaataatattaggctaataggcaggtaaaggcttatgatttttttttttttttttgcatttattatttatttagtgtttgatgtttcttactctaatttggcttttgttgtggttaatttacagacctcacggacagcattcagtggttctggcagaagatgctcccacacaaatgcaaaagggagattttgctcgaaatatcagtgcttcacggcaaatatatctgacgttcccacctgacagcactttcacagaggatgatgtctcaaactacttcaagtatattacatcttttgttattaaagtgcatgttcccatttctttgcagttgttaattatttgcattaatgaactgacttttatatatttcctttgtagcacatttggacctgttgcaggtgtcagaattccaaaccagcagagaaggatgtttggatttgtgacatttgttcattcagaaactgtcaaaactgtttttgataaggggaatccccattgtgttggggattctcgggtgcttgtgaaagcttaccaggagaaggcaaaggttaatgaaaggtgaattccctgtcttttcctttcaatttttttttatattggaagttcttgtagttttatggtttgaaattctcatttattcctgtaaatgtagttattttaagttaatattgtaaaataaaagcttatattttttagtttgaaatgactacataattgtcatcaatattgctagagatagcataatttgatgaaaatttattccttgctgttgattacttgattcccttgttcttagttcttcctctttgttctcccctttccatttattgaaaaaaagagggcaagagacaaaggatgaaatccatgtgtctaatttacacaatcttttatttataatgagtcataaatacaatcaataatggttaccctaatttacataaatacacacagttccctaattacaatatttgcataatttctaacatatttacatagtctctcatacatgtttataaatcataggcaccaagtttatcacatgtaactaattgtgtttggtcctcatgaaatattggatcttaggcaatatggagctgcctgattgtcacatacatgtgtcatttgtgcaacttccccaaacctgaattctttgagcatctattttaatcacattagttcacaagtggctagggccatggcttaacattttgcttatgcattggatcttgcaacaacactcttatttttccaagaaatcatggtatcaccaataagaatgtgccagaagtgataccctgtcagtagggagagcctgctcaatctgcaatggaatatcccacaactctagtcgttcttttgtcgtcttacaggagaacttttctagcttcttcaatatattgtaggatgcaaattgctgcatccagtgtccttcacagggaggattaagtatttgacttaccacattgactataaaagagatatctggatgagtaatagtgagttagttcagtcttctaaccaatggctcaccctaaatggtagaagcttggcattaggatccataggagtgtctacaggtttagcatccatcaacttgtctcctctaagatatccattgcattctttctttgggaaatgacaataccattcttggattgtgtcacctctattcccaagaaatattgaaccttgccaagatattgtccaaaatgtagaaagagatgttgctttacatgtacaatacaataatgttgttgtcaacatacacaaccaagtaaatcaatcctgtgactgaatagcaagtgcattgtttgaagtgtgaaaactagtctgctctgtctctctctattctttaaatgcaaagtaagatggacaaatgtagtatattgaattggtatttacatctaaagaaatcttacgtgcttctgcttatataccttttggtataattctcttgggcattgttaatgtcttcttttccccataatactttcagtgttcatttcaatttggatgcaggaagtacacagatagaattgagcaccctgtttgttattcaccacgctctgtagatgtcgacactgaacttaactcaagtatgacattatctagtttataacccaaattatttcttatttcttatggttaacaattaacttcccaatgattggttttctcatccaagttatttaatgatctgctttctttctgttcccttttgtgggagaagcctttgtacaatctaatgcataattataatttatttagttccaagaagttttgggaaccatagatccattaggagacagccacaactaattgaagaggaagaacaggagcaagtcctggaacttcagaggagaagtcttgcacagctgccgtttgcccaaaaatctttctccagttcacctcattttggcttctccatggatgagtcaaggatttcagatggtgtgtgataatatatgttacatttctatttatcaagtttctgtatgttctaactatcattctgagttatattgattgaaataatttctcatgcagatcacttcaatttccagccagcagaagaatctttcagttttccactgcatgccaaatccaggcatacagactccaattactctggtgaggacaggtatgcatcaatttccaatagacttctctccctctcacattctacttcctacctgttttgtatacattaggcttaattgtactttttgtttctctactatggtcgctgggattttgttcccctaataatttttttattgaatttagtccttcagttttttgttattataatcaagtcctttcctatataagttttcttttttatctaaaactctcaaattctcaacttttgtttgaaaatctctatgaaccagatccattaaaccattttaaatcatcttttgttcaaaaccaagcaattgatacattattttaaatcatcttttgatcccaaatttttgtctttgaaacctcaacattgtacactataaaatgttacacattttatcaaattttgtattgtgaacctttgaagtcattttctatctcattcattttaaatttctagttatttgagttgtaaataactatttgagggttttatttaaatagaaatgatagaaggatttgattgtaaccattctgatatatctctataccatagccaaaccggtaaatcccataaacaatagttcctttcatgatttgtaaaacactaacagtatatttggatggagtattttaaaatttcaggaaatttaaaattcaggaaaattaaaatgcatcaattaaaattcttttattttcaaaattctgtgtttggataaagaaattaaatttcttcattttcaaaattttgtgtttggataaagaaattgaatttcttcgtttttaaaattttgaacctcatgcatgaaaaagaaattgtacttgtgttgggacggagcaaaaagttgtgcagttagagcttctagaaaagaagagaatttcaatttctcacctttttagaaggaaattcaaattccacatttttagttgtttaaaattctgttttaaaattcaaaaaatttaaattcctcacataaaaatatccaaacagtgaattttaaattgaagaattttaaattccctaataaattactttccccaattaaaattttctatccaaacacactctaaaagagatttgtaaaacactaaaagttttctttcatgatcttggctggagtagaacaccattcgttttgtcaagtagcaaatacgagacatagtaaaagttacctctgcttgtttacaatttctgtgtggatgatatcatttgtttgcaaacatgcagttttgctgctatacttttcctgaaatattttgttgactatggataatgttatttatttactttttaatttttatccagcagtcaaggactcaatctcccggacagtccattcgcattttcactagatagtgggaggtaaacagtcatagtttcagatacatatacaagaaatatagagtccaaacagaatcaggccaatggtcgcagctttcttttgatacacaatatagttcttctatggaaatatttctcaattagtgcagtaattttagtcaaaattccagctagtgcatacatgctgaagaagagacactggaagaattttctcttcacaattggaattggtggcattaacaaaagttaaatgatacatgtaagaaggttatagcttttagttacatagcttttagttacagataggtggcaaaacgtttgaattttagatcatatagttatgagttttattcatgaagtcattagtaaaagtactaggtatattattgtccaaagttttaattagattgaaggagctcttagaatccgtgtctatgttttgaggaactaatttacttactatgaaccgctttaataatggtttattgcaagtccattaaaaaaaaaaaaattaaaactacgtaccagagatttcatgcatgtgcaggtaagggggagagatattatacagtcttattcttgcatatgcaaagagattgtttttggatttgaattcatgaccaacaagtcatgggttactaaactagaaatacatagtaagttatgctaaagtagaatcttgaattattgttcagggttgtcatgttttcaggttgaatttttctcactttaaaccactacaaattccatccccaaaaaccatattttgattgtgcatcaactatatcaactgtatttaaactgttagataatccttggtgatgacattactgttaccatctctattactgttatcatctctatttaaactgttagataatcctaatcggtgatgacattactgttaccatctctattatagaaccgtacattgagattttcacttcatacggttgtttcccctacataactttctatctcaaagaaaaagtatattatcgtttataatgctaatgctagataagaagcttgattgttttagcttgcttttgcatcatcaattactgttcaattttcttcatgtaattttcgctgggaaaatatgcttaacgaatgtgaggtattacatgatttaggctagcaggaccaagataactcgagtaaaatatatgagaagtatgaagctcatacagagaccattattcattgtgcatatacgatacgaacaatattagtcacaattcacaaacgaaactttataacaccagcaagataaagtttggaagatggtaaaaaaataaaccaaaatcacttttcgtcattgatgaggaaacaatcattaaataaagcttgccagagcatcatcgtccattccattgtaagcaacatgacaaaagttatacgagccagaaaacaatttttaatttgttaatatttggatggcaatttatttgaacgtgtacctatattgaaaacaatgtttaatgtaatgaaccttaattttaacctgtctcttgcatcatctgctattcctgtgaaatcttaatttcaaaaaattaatccatttccaagcatgtgctaataatttctcgtcatttcttccctgtaatcatccaaaaagtatcttccatatccagttaatgatgcggatacctttgtttttatcataataaaaatatcaatctctaacatgaatctacccatgtttgattataagaaattactttattcattcttctgagaatacacgactgataaattacaccaactcaacataaaccaagcaaccccctccccaaaaataaataaatccagaagatagaattcaattactagtactgaagataaaatgaatgttatttcaactcatacatgtgatacaaatggccgcggggtgacaaaaaaattatgtattggtctggtgcaggtgacaaaggtaacagaagccctactgatctcagatacacaaaagaatgaaaacagtaaaaagatatatctacacaaacacatcgttggaggtaaaaaggaaacatgagagtagcgatgacagaatccataagctggatcttagagttaaaattgatacaccttcaatttataccaataaaagtttgcaatatggtccacaacctgcgatatgttagagacttatggttaataacagcatacttaatgtattaattattaactaacaaaccagctcaccttagggtgacaaatttcaccatgatgtgttctgcttttcagccacaagcacagcaataaaaaacttcacaaaagtagttgggcagcttctgctgagaatcagacactgatacttgagtgtgtcatgaaatcatgtgatgacagtatgccaaatagccagctaaactctaattattgagcttcagccacaatgcagaccatcacgaaaattttatagcaacatgttgcatgacaataatattacaacagattcttcttccagtattcatgcaagttgacagatacaaacttgattctgatctgtcacatttttctttcatatttctcagcaaactttttaagtaataatctctgacgaaatgccaaatatttatccaaactagttccagcccactgttggcaaaagcattcatcagttggaactagagatccaagtggaaatggtccttttggagctttctttagggaaaccaagaacctatgacgaggacgaattctctggtctaaagataagctaagatacatcgggtatttggtcaaggattgcacctcattgttaagttcattaaccaagtacaaatatttgggctttagattctcctccaaggacagagatagcacctgcaggcacattagtcaacattaacaagagatacaaactgttcttcacattataagtatgaatccaaaatatacaaaaatatacaacaatgtcatataacaatatattattttcctagttctatttgtgcaaatgtagggcatcctacaaaaacagtataaattggaaaggaggaatcgaaattaggaacggtaaaacagaataattttcataaactaatgagggaaatgcatgcaaaatgacctgtgttaggctagtcaaaactttcacaatgtctgaatttttcattcctatgctccttaggaaatttattcttggaagtaatccatcatctatgctgtaatggagaagttggggatgttttgtcaccatcttcacaatgctatctctgggtgcacccaactctttggtaagaaatatacaacgagtattccatgaaatgtcaattctctgcacaagaatctggggactaagctgaatgaccttacccaaatctttttccttgataccaacttcctcaattaaatacctaaccgtaggttttaacgaattctcaacactataagaaaacaaggatggagcagcagcaacaatttgccctattctagaattaggtatgcccaggcccctcaagaaagcaacacgagacttcaaattgttctccactgtatactcaagaatttgtggctgcctcaaaaggattcttcttacatctctttgtttaacaccaatactcaataagtattctaacctttcctgtgcggaacacacattaatttgaagtgattgcatgcgtctctcatacatttggacaaagtgtgattccttcattccaaaagtgcttaagtaatcaagaagtggtaaccatttcacatccaaaggaatctcctcggacaaccgcggatattttttatcctttacatttctactatgctgcaacttgaaaaaagaaagataaataaacataaggttcaagagcaccacaagtacattaaatggcacaatttgacagttcacagcttactgtatcacgatttggtacctttccactctcatttctttgtaaggatgctactctctcacttctaggcaatctaatgctttgttcattgtcaaaagatctcaaaccccactcctgttcctgttgcctatcttttcctgcacaaacaagagtctgaatattcaacttccccccttaaaactaataatcaatataacattttcaagcatacctttagttgtctttgacttaaatctcttgttgttattaccatctaagttagcaggctcagaaaattcctcctgcacacatgttccacaatgaaagggaaaattaacaaataaagaaacaatcatcatcaatatcaaatttcaacagataattaaacattcctcagttttttacattggactaaagaaacaattcaaatgcataattaaaaaacccacttcacccatcaattgaattagatattcatcctagaatttaaagaaaacttttgaccacacacaatgaaatcacaaagctcacatcagaaagccaatcatcatcgtcgtcctcgttgtcgtcgacgtccaactcttcatcgtcttcgtcgctatcgtacagcgacagtgcctctccatactttgacttcctgttgctcttgataatcctcggattggaatgtgctgcaagtttcaccaaattcttcaacctcgcagaacccaaacgctctctctcaaaaatccaaaattgagaacaaaaactcgaaggagtcgaaaagtatagcaatggattataaggatagtgaggcataacagccgccattgttgcagagagaaacagaaaaagaatatactccaaaaccctaataatcagaatctctgcactcccagaggtttatcttctttctatctgaaacggtgtcgtttttacttaaaaccatatctgaaacatgagtcacacaatgtaacgcgtaggtggcgcgagcccgtgggctaaaaaagcccacgtggcattgtttataacggtttggttgttgtgaagtgtgaaatgaacgagcttggtcagttagttaccgtaccatggaagcagtatcttcttctttgtctctgctttcgttagggagtgtgaaaactaggagcaaagtctcacagaactgtcatgtgactcaacaaagacaacgttgtaataatgtttgtgttaagaatgcaagaagaacaagggtggctgctgtgcctgtgaatgttgatgatgtaaccacagtacttgaccctgccccagtggaagtcacatggcaaattgtggttggagctataggtaccttaagtcacacagcacaacctttgatattttactttacttgtgatgtttgtttttataggacaaacaaaactttggatgcagtttattaggtgtttttgatattgttattcttaaatcaaattagagattttttttttatcaataatctgcttaataaagatttgcattaaacatgttatcgagatgaaacttcaattctgatttgagagcagcaccaaaagactgcagttatattttgtgcttatctttatggaaagagaacggtgttccgaaattgggttttgattttgtgtgtttgaattttgcagctggggttaccccttttgtggtggcagggattgaatttagcaaaagaattgtaagtcagtcttttggttgagctgctaactcataagttatgaagcccgtgtgtttcatgccttcattgttggataatgttacagttagctcaaaaaagatgtgaggtgtgtggagggtcagggcttgttcttagggaaaaggaaaaggactatctccgttgcccagaatgtggtatgatagcattcacttcttcttctcatatcatgtactctatttaaccaattaagtatgcagctgggagaatgttattgtatgtctctgaaatattcctgatttatggggctttctgatgtctcagtaattgaacatcaaattcagtatcttgaatgtgtgtagttataaattatttggatttacattgaacacctaggaattgcagaaatccctgcattcccaagctaatttgaatatctattgtcaacctgagaatattttgatgttgaaaaggagatatttttcatagatcctctttcttttggttcacagtttctttcattttggttatgagcagctatgacaagtgtatgatggtgaattctagcgtttctttagtaattccactccagcagtgtaattaaagtaccattggttggtctcactcatgaaacttctgtttcaaacccttaattattctgaaagtttaaagagaaaggaataactggatttcacaaccataatatcaatttagaaactttgtaaattatgatcattagtctgacctgtaccaataacgttacttctcattgctttgttgtttccctatttttcttgtcatttatgttttgttgatcaacttttaactaagttattcgtgtcaaattgattaccttacagtccttcatgtgctgtatatcgcaggtgggtttcttccttggcaatcctggaaaagattcttctccggttaatttctacagcattgtactaaaaagcatacttcaacaatgacaactttattttagcagagattctctgtttgtgataacattctctattatacacaaatgtaaacaacatagtaaagccatttgcaatgattaccaaataaattttttttaaaaaacattgtaattccttttttgagagaaatggtatttgctaccttattgatatactcaccctaggaaaaaatttgggtgcatcaatgatgaaaaataagaatgaggacttccttctgtgataagatcaagctgctgcacatatatccgatggctgatttcataacaatgtagcttgttaccaatattagactattattttttatgctattggaggcattttaaaggtgaagtcttgatatttggactgttttttttgaagtggtagaagcttggttttctagctgttttttcattgtaggttgttcctgtgtctaggattctgattgaattgactccaattttcagtaatattcacatggataggatgtaatcagactggcttacacagtaaatgcattaaattgatagagcaaggatttaaagccaatactagtgaatttagcttgggaagcatgagcaagccattattgcattttctgtcgcatacattgtggacttaatatattttaaaagaacttttaatgcaactacgcgattaataaaatttaaaatgtgagaagttactaaatgtgttactacttgttactatcttacaagtttgagaacagatgtttatttgaccttatccctttttccaaataatgtatattcttaacaccaatcatgcccaaattctccaagttttaccgtctatttcaagctacggatagttgttgaacgaatccagaattgaaaaacagatgcctcttgtaaagtctctcgaggccattttatcattttgaggttgattcgtttattccacttacaatatacctcgtattaaatcctttatatcaatatcaataccaacgccatatataagaagattcttttcaaattaggcagccatgattcttcttcatcttcatcttcttctctataactatgtcattactgatgtcacatactcgtaattgttacatgacgcttggctacctaaagtagtctacacgaatctgtaacaagatcttccaaccttatccttcgtatactgtccctacttttaggtgtattgtcttacataattgataattatcttaggactttatcatattgactttgaagagtacatgatcttgcagtaaggtaagactttactgacacacaaaaaagtgccacgttgataaatttatattatgatgattattttttctccattctgaaataatatatttctttgtgtctctaattataagatattattttatttatgagatatagttaacaaatttttatttttattataagatttaattttatttctcttgtgtatttcttattttttttactaaaatatcctggattgtctctttctctttcctatagagatttgagaaagattaatcgatttccaataaagttaaagataaatttgaaaaaaatattataattatagacaaacttaatattaataactaaattaattaaactttttaataaacataaattagacaattatttctcatagtcaaagagatagagggagtagtattttgtttttgtttttgcagttttgcatttaagaatccttggcttggtgcttgaattagtacacagccacaattttggacttctaattttctatctattaaattgcatttaatagtattgatggacttcaactacaaaattatgctactttattgcgtccctttcccgctttctaaagggtgatgtgatgaaacggatcctttgctttgcaaccaactctctctagctcaacctccatcaaatcacagtagaatattacatctaatgctgcacattaattggtcccaattggtccatgttaatggaaattggtcaattgtttttggtatattggtcaatactgacaaattttaatgtcgattgactaattcacaaaacattggtcaatcttccattaacatgcaccaatcttacgattaattgattagtcgtaaaacaagttaaccaatcgctagcctcttaaatgcaatgtatggttgtactagatagtagtaatttgaatcgggaaagtttattagagaagattcaaatttgtaatgtgacattttaacaagtttgttgagtatttaaaacattttattactagtaattgcttctaattatttttaaaaaatattagatgatttgtatttttaatataacaaagatttttataaaacattttctatttttactttcagaatcatagttctaaacgcattcatggggcttcttcttcctttttttttttaagtaaaagaagaagaaaaatagtaaccaccaaaaatttatgacgtatggctgacaagaaattcatgtcatcctatattacgatttatgacgtgaacaatcagggtgtgcagcatgttggtgttgaattgaaacaaacagaaaagaacaaagtgaaaccagtttagttcaaattccaactcaacttccagaattggatagcatctaaagaaattggttttgcaacactcgaaaggaacaatacaaacacagcagaacgtactttaagaagataaagatacatttatgcatgtgggtgtgattgctcgtgaaagggttgaagccaaacgcgtcaagtttgtgtttaattaaaaactgctcttattgttgcaattataatgacgcatatctgcatctataaaaaatggggagaagaaagattattgatggtattatactaattaattttatcattgagggcctacatcaattcacatgtgattgtttcaatttaattaattcagatttgagtttaaggaaattttttgttattcataattattgtaactcgaattgtttacggtgaaagataaatatagtcaataaaaaaaatactaattaatgcctaatttccatccctaaaaatgaaaaaaaaaaaaaaaaaaaaaaaccgtgtgggggcaatgttatcaaccaccataccattaccgacacgcttcattgttttttctttttcaattacacgcgccaaaacaagagacgtcaacaaacgaccaaactaaataaaaatcttcatgtcgatgggaaaaaatcacttttcttcctaaaattaagattaaaatgtaagaaaccgctatgtaaatttctggaaaatggtttaaaatactcattttaactcatcaaagtatgcatgtattgactccttacatgatttttcttctccttcacacgtcagtctattttacagatacgatttgttaagtttaaaagttaagttattgacagttaaatcacgtttttttatcagatgacgtataactgaaatcgttgcttgcatctaatgtttacgtgtcatgcacgtgcgtctgtattcggaacagtggaatccaaataaaacatagaggtttcagacttgttattaggaattaatgaatgcttatcagtttatgaataatctgtcaaaaagattagttaattatttttaatgaagtttcttttcttaatctgtatttctttattcataagacttgattctcaaactcaagactttgtttaaaatttttgaatctaattcagttctaaccaattacatattttaaaaaatataaatatttaacattattaatattatttttttcattttagtaaaacatttaaattttattttgtaaccaacgattttaagatgcgttaaaaatattctttattttttatgttaaaagagcaagtaaaaaattatgttttgaaaaaaatgaagaaataaaatggaatgcttaactgcttaagaggtgattaacagaaataacacgaagttaactttataagattattgacaacgagtaaaggacaaatttgggagataaacatgattgaatccgcttagtggtaattttgtggggggcgagaacaagacttattcattgcttaagtaagcgttcctataaaatatagtactcaacaaccttgtatttgttctttgttgaataataaaaccacaaaaacaaaagcccacatgcatgccaattcctcgttgcatcagttctctattgttttggcttcaaagttcagatcatgctttccttttcatttaaggtgagagtctctgaaaatattgtgctgatcttgttttctacttttcttgttttgtatgaggatgttgtgggagggaagtggttttacttttttaccatatagattatagaagtgttggtgctgctcatgttgaagttgaaggagatgctgcatcttgttttatttatcagagaagaaaaaaagttacttttatggaagttattgagcttgtaaaaatgggttgctgattaacttttaacaatggtatgtttaaccgggagcaattacttccaaggttgatccctttctggtttatagtaatgatttttcactttttttgtcttgcttttcagtttaggtttgttgaatcaacagggtgattgatcagaatttctgtgtctcagtgtgtttgaactttgaatgaatttgtatttgaatgcttattttttatttttagtttataattggaagtccctattcacctttctatgtaattgagttgaagtttagagcatgtttaaagaagtttgagttcaagaaaatattaatggatcttatgagtattcctttaaggaattgaaaatcatgaatagcatgtgggaggcatttctgaacgatcctattttttttttacttttttaatgaacaaataaagggaccaaaaaagcaaaaaaaataaaaagaaaaaaaagaggggtctccctttaagtagcagcaagtgctccaaaattcattatctagttatatttatcaagtcaatctccatttcttgattgcatcaaatttgaaagcacaaacaaaaacaataacatgtggaaagtgaaaagctaaagaagagactgattataaaaagattcaaataaaatgataaaattgctgttttgttcggatgttaagaactatattctgttcatgtggattatgaaaatcagactctctttggcgtgctgctagttggaatagcatataataaatctggaaaatataatatgttgtatagtttgtttttctagttttaaaatgcctgcttatgccttcaataaataatccaactctgttcatattggtttctagcctttatttgagtaatatattccatatttcttaactcctgacatcaaagaataccaattttagacaatagcctcaatactacctgcttcttattccatcaggactgagactgcctttttgttttatatggttatagcttctattattttgctatctatgtttgttgcttaaactgtagtgttaccctttctgcagaatatcttagattttgagaacactgctcatgtccagctggaattggagtaaaatgtggacaacgatcacagaccataaatagaagttcctgttgtttgttgttcaaaaaaatagagaaatcagaaaattcaggagtgtttataccagaaaaacattttggtgttgttttcatatattcaaagtaccagttacttatcaaatgcaaatgtctcagaaacataaaatgtcctatgactctagcaggttcggcattgagcctgcgcaaaatctggggtcatgttgcttcctgcaaagtgggaacctagactactactcatcctctgataacggtagccatgcaacctacccttctgtttgtactttcgaacaatattgcaccctggaatcttctacaaacaacaatttcccttccctaaattctccatctactgtcagtttctcacctaacaatagcccagtctcaaagctgcagtcaaaatcaaatgtgttgagttcccagaattcgcttgaaattgttaatgattcgctagaaaacaaatcttgcttgacacttaacgatgatgagctgaggcacaagataagagagcttgaaagtgctatgttgggacatgatacagatattctggatacttatgataccataattccagaagaatctgattcgtttttgaaagaggcagaaaggtggaagagaatgatggaaatgatatctagaggggatttaaaagagatgctttgtacatgtgcaaaagcagtggcaggaaatgatatggagacaactgaatggttgatgtcagagttgcgtaaaatggtctccgtctcaggcaatccaatccaacgattgggagcatacatgttggaggctcttgttgcaaggctggcctcttcaggaagcacaatctacaaagtcttgaaatgtaaagagcctactggtagtgaactcctttcacacatgcatctactttatgaaatctgtccatatctcaaatttggttacatgtcagcaaatggagctattgctgaagccatgaaggaggaaagtgaagtccacattattgattttcagattaaccagggaattcagtgggtaagcctaatccaagctgttgctggcagacctggagcaccccccaagattagaataacaggttttgatgactccacttcagcttatgccagggaaggaggccttgaaattgttggagcaaggttatcaacgcttgctaaatcatataatgtaccctttgagttccatgctatacgagctgctcccactgaggttgaactcaaagaccttgcacttcaacctggtgaagccattgctgtgaactttgccatgatgttgcaccatgttccagatgaatgtgtggatagtcggaaccatcgtgaccggttggtgagattggcaaagtgcttgtctcctaagattgtgacactagttgagcaagaatcacataccaacaacctcccattcttcccccgttttgttgagacaatgaactactacttggctatttttgaatcaattgatgttgctctgccgagggagcacaaagaaaggattaatgtcgagcagcattgtttagctcgagaagttgtcaacttaatagcatgtgaaggggcagaaagagtggaacgtcacgagcttctgaagaagtggagatcacgtttcactatggccggattcacaccatatccgttgaactcctttattacttgttcaataaaaaatcttcagcaaagctaccaaggacattacactctagaagagagagatggggctctatgtcttggttggatgaatcaagttcttattaccacttgtgcttggaggtgatgatccaatgacaactggttcatttttgttatttcagacttttagttagtttatgtatcatcctattcttctttcgcggaattcatagtcaagttactctatagtttgttaaaataacacacttgatttatgttaataatgccagaaccagcaagctcgatctcatcaaagtagacaaaagaaaaaatggcaagcagcactatgtattctatattttgctatgacacgccttacaaagataaaagaataatgacaatttacacctacaaaacatgttagctgaaaattattacaaaacaaggaagaatagaactgggattttttactacaaatttttctaaggtaaactgcatttcttctaacccagttgagtgagacccttcatattcaccatcaacttcatttactgcagttccagcaattatcctgcaaattattgcagcttttttcacattatgtactctggcagtggcagttgttctgtttctcaactctttgtcacttgtattcaagtgaatctcggcatatcgtgtgttgaaattaaactgaattatttgacaaagataacaagatggatctttacacagatcatgaagtttcttatcagatttttcttgcaaacatctcattgtagtaccatagaaccgcaacagttcgttcccatcaactgtgctccttggattccttggattttgctcagaggccaccttcttgacatattctctatacttctcaaacctttctaggacttcttctgagtaactcaccctgaggactgttctaaccttcttcagtggctttgatttgttaaaccaagctttttgaaagatcatctccacaatttttcttgatgggtctccaacactaagctctgccataattttataatgacattaacaagttagtagaacaaaacatatagatagtgaaagaaaggataaaggaagtaagaaagtataaaccaattgctctagctagtttcttcttataagcccgttacattacaaggacttctgaaaaatcataattcttatatttcaaacttctttatcatgacacaccgagttacactgagttttgaagacaaaagcatgatgtgttcatgcaaataggagcagcatgcaacttagtaacttaccatgaagccttcccagtgtgttgcttggtcttgaaaccactaggctagttggagtttccattagaggtctattatatccattcattttctccttttctgcaacatagccacttcctttgccgcattttgtttgctgcttgattacatcgttgagcttgtttccacatttgacattatccttcaaggagacccatatggcatgcatctcttttttcgctcctcttcctccctgtgtggattgaaatatatgagcacaaaaggaatggcttcttgtgaacaagtttgaccttgttgtctcagtaacatgcacaaaattgagggacaaaaaacaaagagtaaatttttgttcactaaactcattttcaattttatacatatagggaaaaaattagtttatttattaaaggtataattgtttttatttcttgctgtctgttgaccaaattgaaatttatgtatatggataaaagattatattttgtttttatgcataattgttttcaatttagtttttatattttacaatgaccgtgtgttaattttactgcattgtaacggcaacaaagaaaataacattaaaagaaattaaaacctcttttggtacaagttttgaattaaaatgcatgtagcattaggacaaaaatatatttcaaccttttctttttccttctgtccgtataggacacagatgatggatctgttttaaaaatgagtgagaaacgtctgctctggaatgcttgagaaaggcaagactacggtggactctccttagtcatttattgttcttttgtcagttttaggcaagcagttctttgatttttagttacaatgtccatatcatatgcctagctaatcaaattttccaaaagcaagattaacttcaccagttcaatcatgaaatatgttcctaacatataattttttgggcttaatcttacgcttgagttatatcattcatacaacactttttacaatatcaattttctctttatttctcttcaccgcagtatttatcttgcatttttcttctattcctacctctatctgttgtataaaaaaattacaaactatttgtacaaatatatataatttctcttttcatttatgaaaaagaaaaagtgatatgctcaagtctaaagacaaaatagaataacatctgtttgcatattggttctgaaaagtcgcttcacatattaaagacacaatcatacagaaacatggttgtggcttttttctttggtataaagagtcatgtcactagcattgctttttccatttatatgataaataataaagcaaacaagagatcaaactttcttttatctctaatttggtgtttatttctttaaaaacaagaaccattcccgttagcataaaaaaatcataatgggttcaagctagatgatgatgatatagtaaggatacagaattgtgctcatggtaaggatcagcccataatccatacatcttgattccataaataggacacaacgtggctgcatgattcttcagtcatggttaagctaagacaaatatatgaatttaagaaagttgtactttacttgcactgcaattaaagaccaacgtgaacatgtcagaattgttcaaagataaagccaagagaatccaatcgtcataaaggatttactcaatcaatattccaagtatggcagtatgtaaatcccaatgccgattgactaatacaagaaattcatcctatatctaagcaaatgtcgtgccaaaatgcaagatgtatatttattgcaaaaatagtgttaaattcattttgctcttccaccaagctagcacgttcagttataacataattattcaattggctccatcacctttcatttgtgtttctctttctagcaaaattcttgaatgcactccaaagtccaaatactactactacgctaaactaatcacaccttgagaagtggcaatgaaatatgacagtggctaaattaatgttattgcaatgtactaggaacatgcaaagaaaaaaaaccccatttttttcttctattcagttttctagaaacaacaagtgcagcacatttgccaatgctgcggtccccctccctaaattacagggtgaaagggaccgtgtccttttgtatgctgaaaccaaaggattgaattgttaatgtctgtgaggacaaggtatatgtacgtataagattataacatccaccgagtttttcgtatgtgaatagagcatagacacatttatctatattcacatccctctcaatcatattattaaaataaaaaataaaaaaatcgtgttaggccatcttgatatgcaatggtaacatcaaatcttctcattaagcaccgcatcttattaagacaatcattgatcacaggtcttaacaaacatcggatacttatttaagcatgtgcttgtttctgtgtggggtcaagatggtaaaataagtatttacaataaaagaagataaatgttaatcagtactatgaggatattgattaaggaacttaaagtaaaaatatttttattgagagataaaaaattatgttattcatgatttttttttactctcttctataatttatacaataaatatttcttccttttaattctttaatcaataccctaagaatactaattaacaagacccacacaaaaggaatgttaatgttgatgaaatgtaaggagcacgaggttacatcatatgtgagacctatttagttaaataaatgatgatagtgaaatttcatttaaaatgtgtaaaaagtagaaaatgaggcgtttaggatgaaaatggccttagagagtccaatctacacaaaacagtgagaatatccaacatgtacaaattcatgatatcatttattcatttagtgcacggtgcacttcaattttcaccatgacaaaacaggtcatcaatcacgggttatgtacgacttgtaaccagtgcagtggggactaaggttttgtggaggtaactttgatatcagcttcatatttatacagaagaatttggatataattataatttataattatacaattacaaacggcaattagatttaaaagtcaagatggagctgctaccaactctactaaacagaagcgctatggaatagtgatataaacataaaagaactatctgcattttcttacagaaaatgagatgttacacatttgaagctatacccgccaaaaataagaaaaaagaaagcaaattgttactcatagttttttatttaatatctgttgtgtaatcaacttcatggacccattagtattcttcccatgctctgtgggtatggatatgaggaacggtttaaagatggaccatcactcctattgtctctagaaacatagggatttgagctgttatttagaacaccaaagtatactggagccgaggtagtatgaacaaacttgaagttggaactgctagtatgagtttgtgtgtccccaaactctgaatgcagcattttcccttgcccatttgacctatgttcagcagctgagctaattcccattccaaggtcaaggctaatggtatcactttcttctaacttagttcttgtctgtccacctgctgcagctgctggtactgccatgtcatggctgctattctttgcagctggtacatcatgattgtgtttaccctcatatgtggttatcactgcttttggatcatgagatgccctctccacatgttttctgacagggcaaccagcatttgtgcatttgtaatagctcctgaataagaagcatagtaagatacaagattaacaaaaaatatgtagttgagtagcatattttagcactgcagcgagttagtatcataagcatggatcattaacatgaaacaagcctcattcatcaaggtcgaagcacacatttgattttaattccaagctttcaagcatttcctgaagtagcgacacactaatataactggaatcatgagaagtaaccttttgagtctgtaattatggcatccacagtaatgattgtcaccacgaaatagaaagcgttagtacatacatttcctaggtgaatatcgccctatttataaataattgttcacaagtgcccaatgacataataaaatgacatcaataagcaggcttagttgtaacattgggatcggctacactagtcattcatgaaaaccagcaggatggtaatcctactttcctaccatcttcataactgagtataaaaattgcaatgatgcctgaatatcttcttgcccttcctcttcaccccaccctaagttttcttataacttcgtattggcttgcaaaattaatattcactcctttcctttggaagcaacatatattccacaatactttcctatatctaataatctactgccactttaatttgccactgtttctttgcaaacttttagaaatcatgcttttaatttccaacttgtatcttaattactaggtatttagtcactctagttcctttttaagatcctccatccccaccagttctcatcaaccttcacccatatgtccatctcagtatcccttaccaaaacaaatctataaagttattccttgtatttcttaattaaacccacaaaagttggtgcttaccaaaaattccctccattttttgcaaatatatatatccttcatgtctgtatatctgaatatactctaatgtaagatacacactgttttttatggaccatgttggctacaaagctgcaacaggggcctcaaagcctcagactatactaaaacccatgataataaaagaaacagattgcaaagcaaaatggttgataagtgaatatatataggcttcaataaattattatatcaagttgattcctcactttaactgttgtctagacatcaagtacaacagaaaaaacttgacattttacaatattaataaaaaagttcatttgacaaagcacattcattaaattggaatttataaattaatttctattcttagtttcatcaacgtgaggacataccttgggttaggattgcctctcacaaccttttggccatacttacgccagcggtacccatcatccaatatgtcaacctcactcaaagtttgtacaacaacccgtggttccctaataggcttaactacaggagtgatgtcaacatttccaagttccatttttctgctcaaaaaaaaaaaaaaaaaaaaaagaaactcagcagcagcaagtgagcacacatgctggagaaaatccagagcttcaaccaaattgtcataccttcgctttgagaagggatcgtcattatcaacctcttcaatagttctgtttgacgcaaacccggcaccctctaaaccatcataatttgttgctacaggtgatgactctggagtactgttgggctcagcagcatgagacacctgaccatacatagtggatgctttgtctacaattcaagaattagaagaaaagaaagccagttattttgtttgcaataagtaataataaaatggaagctaagatagatggctggtattaccatctcggccagccatagaagccttatcagatctctctccttgaatagacataacagtaccagtagagtatcggcagcttggttgaggtttaggatgatcatgtgttcccttgtaaactatctctgtgatttgaccatcatgagagcgctcaaaaagttttttcacttcacagttgggatgtgtacatttgtaataactgcgaggaaattcacttcctttaacaagcttttgcccatattttcgccaattgtatccatcatcagatgttttctcagctgcaactgaaagtccactgcctctaacctcaacatgtgatgcttgaagcccagtagctgtgttgcctttgtggttaatgtcatccaaatcaacatcaacaggatcactagcactagaactaaccttttgtacaggtgatgataggcttaattcattagaaggaactgctatctcactttcaactatgggtgaggaagcaaatgattgagtttttcctggaccttctacttgagtagattgtttacttacatggttgttgaagtctgcaggaaccttaaaacgagtgaatagcattggataagtgctaggcaattagtaatattcaaaacaatattaattagaacatgaaacatgacaacgcaatttgtttccatttaacactttaaccccccaaaaaatatctatttaaaggattataaattataaaactacttaaatgaaacatgactttcggaattgattttgtctaatgcgacaaagtgatgagtaccaacaatcttgacaactttcaaatctgattaattattccatcttgtttagttagtatccagatttaaaccaagtaaagtcacgggagaaagggaaacaaaatccaagccccttcatccatgtgatttgaaagtaatattaatcaaagtgttgccaacatcgattttaattaccatattcgatctattcagtggtttgaattcaaagaaacttgattttctggcatcaacggtattggtattgaagcaggcagaggttactggaaatgtagcagaggaagcagaagccatagaaccatgtactgttggttggagcttacggaaggaccctgtagttggtgaaacctccacctgcaatgcatggacacaaataatatttaaactataatattctttgagcaactgttgttgagtcaaatgaaaaattataaattcaaatgcacaaaaagatactggaaaaaataaattctcaaaaaaacaataaaaagaggggggagggggggaagccaaaacaagcaagttcctgaatacctgcaaaccctaaggcctcaaacagcaatcaatcaacctatgatatcagtaataacagcggaaaaagagtatatatatatatatatataatcttatgaataagccaactaattgaacagttttatcagccagtgatgtaagcaacccattataactgagcgtaagcaaagttctccattttctcctgctgatgatattgcatgttgtttatttggagtcagtttgacaaagatagcattgtacattataatatgcaaaagttagttatataaacaatcaatcataacaaagaaaagacactctcacatgaatgtagcacagaattctactcaaattaggaccatccagacgattaacgtctagaaacaagtcccacaaaatctagacccacaatctttctggcattccttatactattctcacagcacaaataacttaaatcaatccactaatcgttgcaatgcattgattcgtttgttccacatatataaatagtaaaggaaaagaagacgacttttcattgcactctgctgcaccgttgaaacaaaaacaaacaaaaagggcaagcaccaacaaaaaagaagattcattatgtgaaaaaacaacactgacactaaaataaataaaatgagaatgtcgagcgatcctaagctaaagttatattccactaaacagaacaccgtatttatttgagcataaagcagccaatacataatcctataagagcaaaagcatcagaacctaacggacccatacacaaatgaactagtaagtgaaggatcaaaatcaaacaagtgaagagccaactctaaagaaacaatgtgccacgagactaaaccagcatataagaatttagaatttcacaaaacaaaaaacagcatcttcagctcattgctcatcagcattcaaatcaagtcattttaagttatcaaattattccaccaaaaaaaaaaaaagatttgacaccaacccagataagccctattgagtagctgagaaaccccaagaaaatcgtagtgaaaagaacaaaactttgatacgccactcacaataagtgacctttaccttacatgggtcaagtaaaaataaaaaacagcaaacaaaacctttgaccaaaatgaactcaaaaacaacaacattcccccaatgaattcactcaagcatttacctttccttcttctaatccatttcctctcagaaaacacaaacccctttgaaaaatgaaaattctccctcataacacaagccattttatttccatttttcaccgaaaccaaaaagatttcaaatgagcacactcacactcaccttcatgttggaaagaagaaccggggattccagaaacgacgtcggactgagccccggaggaatcgtgatgcacggtgacctcgagatcggaagcttcgccggcgacaacagcttgtacctcgccatcgaattctgacccgacccgtttcgattcggatcctcggatgccccagtattttggagcaccgaactggagcggggttcgccggagttggtggcggcgtccattgtgggcggtggcgttgcggagagtcaaaggagaagtagggagggaaggaagggcaaaagggtcatttcaatgatgcattttggtgtgtgttgtgtcagagatgtttgggagagcagagcaggactctcagttgacttgcaacgttggagggatctctttctcacacaactcattcattcatctgtgactctctcttctctgtcattttaaaccctttctaacatttttttttttgttacttcttagtaactaaactcacaccataaaaaaaagtcatcatgatagtaataattgatgttgaatttaaggagttttcatggttggatcggattcattcagattttgaaaatatttttggttctatgtaaaggtaatctttttgacaaatttatttttaaaaaatgaaaatttaaattttgacaaatttatttttaaaaaatgaaaatttaaattttagttcttaagagtgaaaaaatatgataaatacattgattggttaacttttatctattatagttaataaaagagcgtatatgatacgaacaaaaacgtcacaaaaatgattgtttaatatgactattaaatagattggaccaaaatgtcaataaatttttcttagactaatttgttagatcccaaatttcgtttcatttaaggaaaaatataatttaatcttcaattccctcattttttatcgttgcaagcataacattataataaatacttaaaaaaatagaaaaacaaacataataataagcataatattgattaatagtcatgatctatatattactcgaaaatttctaatgtgtcaccttatccaaaatgaaatgattggtacactaacaatttttttgtattgttacaatattttgggtaaggtactgtcacattaaaaatttcatcacaacagacaaattatacttattaatcaatattatgtttattattatgtttgttctaacttatatttgcttccctatttttttaagtgtttattataatgtttattctcgcaatgataaaaaaaaggaggaaaatgaatattaaattatattatacctttaaatgaaatgaaatttgggatcataaattagttcaatgaaaaattattgacattttggtccaatgaaaatttactgaaattttggtccaatctattcaacattcatgttagtaatctttttacgtgacattttatgtctatctatacctatatcacgtaagctctttcattaacggtaacaaatgaaagttaacatatagataaatttgttatacttttttaactttcatggactaaaatttgaatttcatctttcaaggacgaatttgtcagcgctgtatacattcaggaattaaaataactatttagccttaaattaatcctattaaaagtgagtttgtttaaattttaaaaaataactttaaaataaatatttttttatataagtgtttctttaaagaagtagataagatttattttttaaaataagcaaaaaaatatttttaaaaaactaaaacagtgtagacaaacacattaaaaaaacaaaaaagttgtttcttttattaaataaatattcattccaacaaaataagtttaaacaaattggtcctaagattataggagtatattggtttgattcatgtcatgataaaaaaaattattatatttttaactttttgtttttatttattgtttattttatataatttttcaatttttttatcattatataaattttcaatattatattaatatgataatataagatagaaattttctttcttttaataactagtttttttatcaaaaatatcaagaagatttttttttaacaaactttgttattagttgaattttattagaaatcataatattataggagtcttattttttatttaatgaactttactattatgattttcaataaaaatttataaataagataatactattatataattggaaatgaattagagagtgtatttgtaacattccttcttcttttttacttcatttagtatttagtttcttatagttattatattaaatatttcattaatttatttatccaaatatgataaaaaaatcataaaataaatataatcaaattataaggccctcagtaacactagataaaataataagaaagtcaaaataaataaaaaaggaaagaaaaacaaaagtagaataaaaatgaaatactaaaatctaaaatcaattagtttcaaaagttaaagaaagaaagttgataagacgtaggattagtttggattaaaaaaaaatggaaacaaaaccaatcataattgattttgcttatatttaaaatgaaaggaactaattgatcaacaaattcaaactaattatattagtttggtttggatttttagatttttcaagtcaagatgatttcataatacccatattgaattgtttgtagcttaatacacatgcatggatcattattattcaaaaattattattaatataagagtaaataagatatacatcaataatataaaaaaaatcatattatcattcgattataatcttgtaagtgtaaaaagttattattttacaataatcaacttaaaaatcatattaacaataatttcttattaattgataatataaaaaaatttacattaatggtacatacaaattaaactcttaaaataattattataaaaattaatacatgtaagtaatttgttgataatataaaaaaaaatacagtatatattatttattctttgtttggaaaaaattaaggcgtgaacggatgggatggagagagaaaataatcggttgtgtagatttaacttttagactttttaaagctgataggtggatgattttgtcaatgaatgattcactattggacaaagattttgtaacaaaatgattattttactattcgttaaaagaattattattttttgtgtttgatgtgtgttttggctaggtaagagttgaaagtgaaaagtggtgtgccaagtaccaactctatgttactcttcaccatacacaatcaatatgagtgattggtgcaaaactgcggttccctttccacaagttgaaagccaaagccaaaccagaattggttcagcaaagggttagattcaaataatttaatctcatgaataggagagtcaggctcaagcaatgacctcagtgtgtagttttgtctatgttatttgaactttgatcacatgattcaattcaaggaatgctctgtcggcaattcccatggggaaaattagcaagtggatgtagcgaagagaactggattaaaccataattagttcacagaatcatgttgtgtttgaggtttttggacaatactacctggtttagggcatctaaatgtggcaattgttgacctgaccaattaattccatttgggtttgctgattttaaaaaaaaatccatttgggtatttttcagtcacaacaataaatgagaatgttgtcaaattttcatggatatgctgtaaagatctaagaaagaataagttaacatgttggcctcacactattaaatatcttctttactaatctcataccattttactaaaaggggttaaaaagaagttaaggctcaatttttggtttactactataatgtatagagtattattaatgaaatatggtctagaaaagcacaagagatagaaacatttcattatagtttgttttcttttctccattcggtgtgtgtttttactttttacctgtgtggagacagataagaaaaggaagggtgtacttagcctataattaggtgaagagataggaaaacaacgacaaatctaagcatttaacggcttgagatgcagttaaagcaaaggtctcactggttttctaattccttacaatttttttatagagtaatatatttcctccctaatgaattttactatattaaatgttaaagcatgccacattcaattcaattgcatatcagagcatgctatccaaaaataaaatcacctaccttatctatctctctcaacattttttcttatttgctgacaaaatttcccagataaaactaaagtatgaatcccttatttataacgtagacagtagaaacagttaagagttgttaatttcattggcattcctctcaccatcttaccgaccatctatttatccaataattttttgccactttacaaactttggaaatggctgagtgcatttgctttctcgaatttatttaatgaatgaaatttgaaaactgtcgcaaaaataaaattatgtatagaaagagagattttatcacattaagagttcgttaagtatcttcagaatttcatgtgaaaatcttagaggtgaattttggataaaatagtttaaaggataaagaaaactcattcttaagatttttaacaatgggataccaaactaatttttaaatttcagaatgtggagaagaaactctacttttttttaaaaggaaaggtactcaatcataaaaagcctgtttgttaatacttttattaatatgatcccttaagtatgctcagtgctcacagaggtttggatcttaataatgtgtacggaattttttttattagatgagatagagcctatttcaattatctctatattttaaaagggactaattttcaactattagttaaaaatactcttaataacagtatctcttactgtattcagtccatcattcttaattttttataaagaagtctatcattattgttaatgaaatgatatgattctgcttttggtcaatatatatatataaaggagcattgaataaaattttattaaaccccaataatattaaattttttcttatttttaataaattgcatattttattgttgattcccttaaaatttaatgtatgaaaagttcctattgatatcattcaaaaccgaaggtgaataataaaatattgatgaatcatatattaaaaattaccaaaaactgaatagatacccatcttacgattgataaattgcttctagttgttttgtcttgtattgacaaataaattacctctatttgttttgaattttcttatcttttcggcaatgagaataataaaaacaagaacgtgtataacgaggtaggaaaaacttcctcacaaaaatagaggattacttaaattaaaaatccagagaaaattcatttcatgaaataataacgttgaacagctaaaacaacttatacagaaaactatgtatttataattttctagtattcaacgcttccaatttactaaaacatgttgtctaaatttttttactaaaacataagaatgaattaagtttatttaatatttctgcatatattctataattaagttttctttgacaaatatttaaatcaatcaaattccacttttcaatctgtgctcactaatatgaaaatcttgactccgcatagtgtatttcccactaatgttaaatcttgtaaaactactcatgtcccgttgataaaaaccataacacagacttcaataatatattcactaatattctttgccaaattcaaacttctatgcttaaagctagtcgtccagggtgagttacaccttgttagggatgcaaagtccatttcctctgaatgaaattctcactattcactaaccaaaaaagaagaaagctggccagtcatctacggcccattttcatggaacacactgagaatacgtctcaaccatcagtgtagtaaacatttccaaacatatagaaaacgaggtctcttacatgttacattaccaattagcaatgatctcaaaaggtgagaggaacaatctatacaacaccaaataataatacagacacatcttttcttaggtaatagatcacttcataggtagaacagtgtaaaaatcctctcatacacttacccttctttagtgttaactattctacggtaaaactcaagctaatgcacattgacagagctaatgacgtccaggaaacttaaagatcaaaatactgtacgtacagaaacatgtatcacaaaatcagctggtgctaaaattgttaagagaacctccctagtagtgtgtgtataatcgaagtgtcaaaactcattttctcaagctaatcttattccaccaacattatgttggttcgaatgtaattgagtttctttaagtaaaatcttgaattttgaacttgagaatgaaaatgaacataattggaaaggaatatcttttattaaagatggtcgtcaatttttttataaaaattaattattaacaaagttgatagatactttacacttacaacatagtaaataaaaaaatgttaatcttaatattgttttttatcattagctaatcttaatctcaccagcctcaatgtgattatttctttatattctttttttttttggaaaaaaaaaatagagcgggaaaatggttgctgaaatccagattcaggataggcccacgcagggcactcacaaataacccaccataaggagacctgggattcaaacttaagccacgtgtttgtcatggacttagtgcgatcaagggagccaactcccgtaggcaaatttcttaattttctatgattgacagtactgaactttttacccacttcatgatttaaatgatgcaaaatctatagactaaaaaatctcagacagcccaaaagtttattttcctacaagggtttaacttcctacacccaacaaatttctaatacacccagcacttatttgtgaaataccataaatatccttcttgattactttaataaaacaaaagcattcaaaggtgatttgatttttctaatacacccagcacttatctgtgttttcgcggctcttctccttctccttcaaacctgcgattttgattctccggcgcattcaatggtgtgcggttcttgtctgtggctgtggacggagctggtggtggtcggcaaagctgttctggtttccggcgcgacgaggtaagtgacctttggctcggagtcgtttgagttttggatgcgtacagatctcgaatccgtaagctgtacagtatacggattacagatccgtattaaggaatgtgagccccgttgccttacggatcaccaatccgtagagtccttacggattgccaatccgtgggatcattacggattgccaatccgtgggagcctcacggattgccaatccgtaggagcctcacggattggcgatccgtaaggaccccacggattggcgatccgtaaggctcccacggattggcgatccgtaaggaccctacggattgccaatccgtgggagccttatggattgccaatccgtaggggtatttgcttaaatttttttaaaaaatgaatgaacttaactgctttaatgaattgctatgtgtttggtatggttgaatgattcgtaaagtatgttgtgtaatggtatggacttgttagattattttttatcctcgacatgtgtatggtttgatcgatggctagataatgtgtaatattatgagtaaaatgaactctttaaatgaattgttatgtgaaaagcttgttgtctaatggtatggacatgctacattggttttgatctcgacatgcatactatggtttgatccacatttgttacgttatttgaaatgtgatgagcaaattgaactgttttaataaattgaactgtgaaaaacatgttgtgtaatggtatggacatgctacattggttttgatcctcgacatgcatactatggtttgatccacatttgttaggttatttgaaatgtgatgaggaaattgaactattttaataaattgaactgtgaaaaccatgttgtgtaatggtatggacttgctacattggttttgatcgtcgacatgcttactatggtttgatccacatttgttaggttatttgaaatgtgatgaggaaattgaactgttttaataaattgaactgtgaaaaccatgttgtgtaatggtatggacttgctacattggttttgatcgtcgacatgcttactatggtttgatccacatgtgaagtacatgttgtctaatcgtatggagctggtagttggtttttaatctacttgttaggtttcgttatctgaaaggattatgcttatccaaatgggtatgtttgtaatgtaactacttggtttcaatgtcagattatggctaagacgataggattacggtgggctttggcaagagatgccagtgaagaagaacccgctgtacggcgaagaccgacagcatcagcacggagacaacgccagaggactggtgttgttgaggacgtgcctgctgaggtagacgctgacgatgttgaccatggtgcacctgttgaggctgaggtcgagggaagcatcgatgcctctgatgttgacggatttcccggtgggccccaggacacttcagtgttgagtcattacgatgaacatattgcacctaggatttggaggggggaggtatgattgtatttaaacatagttgaatttgataattattttcgcgttagggtatgtgtatgtaactaacaactaatacaggaactgccggagcttaagttggcatctcatgggaggaaggtgcataaatttggccggcctgcgcctgagattgaagggttggtggcaggtacaagattaagcccactgatcacctgttcggtagatacaggtgaccggggtttaatctcggcatttgtggagaggtggcataaggagactagcagtttccatttgccgatcggagagatgacgatcacgctggacgacgtcgcgtgtctatttcatctaccggtgatgggtgggctgcagacgtacgatgtgttggacgttgatgaggcgattgcgttactagtagatttgcttgaggttacccatgaccaggctgcagcagagacgaaacagtgccatggaccttatgttcgtctgtcatggttgcgggagttatatgatgagaggtgtcagcagatgcagtggacggtggcagccagagcttatttgctccacttggttggttgcacgatttttgctaacaagagtgccacacatattggtgtggtattcttggagccatttcgtgatctccaccagtctggcgggttcaattggggggcggctgcactccaacacatgtacgataacttgaactacgcctgtcagcatcatggtaaacatcttgctggttatattagtctgcttcaggtaaattttttttatataagttaaaatttgttatttgtttaatgtgaaagtgaatttcaactgcttatttgtgtttggttgtttttgttacttaagtgttgggtatacgagtactttccaagtgttggcagcatgattgcggataaggactatgtagagagccagccacgggcatgtcgctggaagccggggaaggcgttacctgtcagttcctatcggaggcgactagataggttgacgaccgacgctgtctgttggactccatacatcgatcatcgtccggtccgtccctttgaggtcatctgtctctactcaggttatatttgatggggtccttactgtgtcaggtaccttccagagagggtactcagacagtttggcttcattcagaccatccccattctcctgagcttgcccaccccgtcagatgaagaggtggatgacagctggcttcattacgcccaccatcttactatcacaggacccccttcccccggccagtgcgaggctgcatacatggactggttctaccggatatcacaccctttcatgtgcccgcctaagcctggggaagacagagcgcctcctcatgtgccagttaccacagatgatccaccatctactacggcagaccccacgggtgacattgcagctgatcagcctgacatgcctcgacatgcaatggtaacacaaatttgtaatttattctcgtattaaaaaatgtttaacctgtgttatgattataacgaccgcttacacagtttgtctaatttttattgcaggccgcattcgaaaccattgcagagaggttgcagaggcttatagatcttcgcatggtgacctctggcaccgatgtgtacgagactgttgccaactgtgttacattagcacgcagtgtctgcgatgatcggagagtgtatgttcgctcgagacgtcgtaggactggaccgcgtggagattgatttgttactttttttgtattgttgacaacatatgtattaacattattgtattgttgaaacatttcatttcatatatgtaaatgctttttaacattatccatctgcgacagtattttgtcatgcgaaataacagaatccagcagttaatacaattacataaccccctgccatttagttcacaacacatgaaaacattacgtaaagtcaaagcatgtcagaacccagatcaacataaactggtggcaatgttgtcaagcttgtatacttcttcagtcgactaatgtaactagatggccactcatttgcttgaggctgacaatgtcttgaccataataatgcaattggtggcataggacagccatctcgcaatgcaacctgaacacaaaccgttttattgttaatgtacacaagtcaaatgattagaaacacataaaacgacattagttgtacctgaacaaaatggtttccatatacatgaccgatacaaatgacgcgatgtcccgcaggatctctaggcggttggcttctaagcgggaaaaaagtcatactttgttgcttagaaagacaaacaagaactaggttataacgtgaagcaattacataacccatgtctgtaacatccatccatttatcctgtgttacctgcattttaacaaagtataagtgttatgcaccacaacaatatggtaatattgtcaatcacagacacaagtcacatttaccattgagaatccgtccacaagtagtgatctttttaagtcctcaaatctttgtaacccaccaaacaatataatatagtctgcagaccattcgttaagttccttaagcaaattgttacgaaccacaggccacccatcttcaccaaaacccagtagagccgcaataacccgatatccacaattaccatcggctttaacatcacatacaccaataatgtaatttctcatgcacggaaggaactgatccagcattggaatatcacccatcggtgaagcacctgaagatgttgaagcggactgtggtacagaggagcaactatcatgttgagaatgtaatgcgtcgacgtactcaaagtacgatggatctcgctttgttgatctttgatacttggtaaggtttttcttttgagccccttttgtcttcaccttttcaggaggaggacacattgatgtttgatcaggatacgcaatttctttcaatttagtcttaagagtaactttgccacacaagtcaagactttcaaatcgcttggatatcacttcccactcttctgtgatggtcacctccatctcatcaactgatgagtccgacatatgcaatctccgccaaaacatgtgtaccgtgcccagtggtatgctgctaacattatactttgctaactcacatgcacaaggcaaaccatgcgtacttcttaacacacatccacaacgacaactatctacacctacatgcttaactcggtctaactctgcggcaatttcatttaacgcatacctggaaaccatgcctacgagtcttttgtataacgtggttttaaacatatgtccaacaacatgtgtgcttgtctcaaaagaagccttaatctcattgtgttgtaacgtgatcatgttgttcatcgcatcctatacgttacacaaatctccaagactgtcctgcagtagtctctttaaggtccaatgggcagacttaaccctgtagtaaacggttaaaataacaccggttaactaaatgatgaccatgcagtataatgtaattgtaaactttctattgtaaagcatttacctgttcgtagtggtgtggccaaaatgcatcactttattagtccaggctgtgacaaatcgttctttgtgagggatcaaccacgtgtctttcacatattgaacaaatattggccatggtgcacaaacacattcaaacctcatcagacactcatcccattcattttcaaaagcacaatctaccagacttccccatgcttccatgacaaactcccatgaattgttttgtcccacgagcgttttacatttttccttgacattcttgtcaatgtggaaccgacacaacaagttcattgtgccagggaaaacatctttgatcgcattcatgagggctgtatctctgtctgtcacaatgacatcaggaaaaaattcagtcttcaaaaaaagccctctaaatcgttcaagagcccatacaagattgttcgtacgttcgccctccaaatatgcaaaggcagctgaaaaagtcatcccggtaggtgtcactccgactatgtcaaccaaagggagtctatacctatttgttttgtatgtactatcaattaggaaaaccaaatgatatgaatttatcaacttgactgcatccggatgtgcccaaaacatgtctcggataacattttcttccttcactctatgccagtggacatacatatcacgatgaagaagcttcattaaatgttgcatttcagtattgttgcctcttatagaagtgcggtatgcatatcttgcattgtacacttgtttcattgttgtataacttttaggattgcgatcttttaaagtgagcataatatttttgggtttaacccttgagtttgtcatatcaccaacaattaccttctcttcctcagttaaacgaccagcatatggatgtccagtgaatgacttagccaaacaatggttgtgtaacccgcagattaactttaccatccacccttcaccacctatgacgggtttccctcgcaacttaaaaggacacccgcattttctactgctagtggtcatgcgttctaaatctttgttgaatgctctatactttccactcctttcacaacctatcaaaataaatgtggtccttcccctcttaccagttgttgtgtcagacctcattatcacagctacaaaaccaatctcatgtgcaacactacgagcccattgcaatacctcgtcacgagaattaaacacctacaacatttcagaatacatgctcaatctcatgaaattatttatttactgacattcaatatgctactttatcacataaatacctttgaagtcttaaatgcatcagaacaatcaatcacagaattctcattctcaaatgcaaacggttcacctctattgtcttcacccatattattttcttccgccataatatcatcatgcatccaatcatcgttatccatcttaataaacaaacaaattcaaaacaaataatcattaacaaaaaatatggttatattcatttcacaactttgtgattaattcaaaacaaattttcctcataattcaaaagttaatggttattttaattcaaagaggaaaaatacaataattattaattccttttaacaaaaacaactcaaaataacaaaaaaaaaacccaaaatcaaaacaaacagaaaaaaaagccatacggattggcaatccgtaggagtcacacggattggcaatccgtaggagtcacacggattgccaatccgtgtgactcctacgaattgccaatccgtatggtttctgctacaatgattagttgcagaacgtacttccgacgacggcagcggccaatggaagctccaccaatgctaaccacgacctcccgaaccaaaccaaccacgcaagaggcaccaacacgcagccaacaaccaacagtgaagacgcgaagaagcagaaggcgcatggaagaagaaaatgaagaaaaaacctgctgggtgtatgttaaaaagcaacaagggtagtattgccattttttaaaaattgctgggtgtattagaaattagctgggtgtaggaagttaaacccttcctacaatgtgtgtcacataccttggattagcccaaggtgataggaacccaaacatattgttttgggctgcttcataaaaagagacttcaactaccatagaccaaagcatacataccatgattcaaccgaatatcactaccatgatgacatttaacatcaattcatccacatctacttatgatactcaactaaactgctagtaacacaaaggaaagaaaataaaccagagatgagaaactgatctgaataccagacctagttgaaaggtatttttcaacatgagaacaaagacagttcatacagggaagtaacaaaataacaaaacaaatatcttgtattttttcatctgtggggatgatgcctggtctcatggatgagaacaatcaatacaattctcctagactttatgttaaagcttacggaatggatggattaccctacgtttttggattaaaatcctcgaaaacaatggatgagaaaagcgagtttctatctacagtgagaggcaaccaaacaaaagttaaaatccagagaccagggagagttgttgtctgggatgtcataatactaaatactttcaatcccattattaaattttgataaggttaacccataatttcctttaaatatgatttctgtttttcttttactattatgaactaggacatgaaagaaaagaaatcaagcacacatgaaactgtagtgtagacacgtttaataagttattctcaagcaaaactgcacctgatacagtgacacaaatatggaagtttctatttgagatggttttacctttgaaacccaatctaagcctcaataccaaacaaagaaaataaaggtaggcatgaatgaagagcaagaacagaaaagtttaaggaataccgtgaataacctaaaaggaaacttgtagatgtaaaatcattcaagtaattaaaaattgtgaaactaatcattccctcacaatccttcattgctgaatctatggttcctttcctttaatcatggagatcaacaaagcaagctatgcttttaataactaaaagccagaagtgcaaagtcatagagaaactaataccaagccaccaacccaggagttcagttttcaaaagaaaacgaaatctcaatctactgaggataagatgtttggtaataatgttgctgaccataaccaccataagcagagccactatcataataaccagaaggcataagtggttctgatgaatttggaagagaacaaccttgaccaaggttgccactgggacccattgggacaccatcaggaccataaggcccagttgaagcgcctgcattaggcaagatggatattcagattgaagattactacactcaataaccttaattgccgatttcagtgcatggatttgtctcgccatgatctcactctgcaaaaacacccaaataaatacaggcagtgacaccatagaccaggtaaccaatcaagcggaggatacttacaagtgacttcccttcttcggaaagtcttttaacagtttctgagactcattcacgtgagctttcaaaatgggaaccggtggaatcttatgagcaagattgaactcaaaaacaaacttgacagccaaaatatgtttgctcctgtcaataactttctgcacaagacatgcgtaacacccaaaacaaaatttccctcacaaattaaaccaccaaaaagtgtaacactagaaatcaaataacagcagcatcaccatttcaaattacaaccttgcaccatttttgttattaaaaaaaattccaactccagaccacgcaacataaacactaggggcttaatgatgtttaagaccctgaaaaatggacatcattagtttttgtccgtgactttcaaaaccattagtttccgtccatgtgtttttttaaatatccaaactttaatcctctaaagctaaaattgcaagggactaaaatattatgatattaggggataaagtttggatatttggcaaaacatacggacgaaaaattatgattttaaaagtcgccaccctaaaaccaaagatccatttttgatggaatggaaacaccataaaccctaaacactactgtaacaacaacagttaagaaactacaagtacaacaaaacaaaaacacaaatactgtaacacaataccatctcctaccagctcaaataaagcaaaaaatcaaattcaattaagggattgcaacctggaactaaaaccaaagatggccctcacagacttaaaacaccattaaccaggggtgtaaatgaaccaaattattcatgaactattcgagtttgactcatcaattaatcgttcaaacttgtttgattaattaaaataaacaaactcgagcttgatattaagcttgaatatttaaatgagtcaagcccaaattttaaaagcttaatattgatattaagggctcgtgaatagctagtttatatatatatatatatatatatatatatatatatatatataagttttatttaatcttatactagtatttatttatgatagattgataattttcattaaaaatttatttacttttataatttttgagttaaattagaaaatataagataagattaaaaagcaaatgacgtttcaattgctttgagctttcccacttacttttcttttgcattgtaactcaaaattttgaagactcttcctttgccaaatcaagtttttcatcttcaaagcttttctcccaaattaaaattccaagattataaatgagtcaaaaaaaacataactgaatgcttctcatagtaaaaaaaaattctaccgaaatcgaaagtaaaaaaaaaaatgtttcaaaggattttttcagtttccacatacaaagaagcttttcgtggaaataaaaattattttctagaaacatgttgtagtaaaattccaaatccttttcattaaaaaatggataattgtaccaaataacaatattaatcactgtaaaaataaaaataaagcaatggaaaattaacatacttgaagttgattggtgtcttgcatgagaggggtccgtcatatttgaatagttgaatactagaatagaatgtgaaacaatgagtgaaggaatttgaagcacctgagattgaatttgaaagtgatgtagaagagtggtccactggcccggtagaaagtgaagtggaatttgaagcacctgaaattgcattgtaactcatttaacaagccaagcccaagattataaatgaatcaagctttagccattaatttttttcaatgatcaaacccaaaattcaagagctcaattcaactcgtctcatttacacccctaccattaaccctaaacactagtgtaacaattcataacaacagttaacaagctacaacaacaaaacaaaaataaagtcacgtcataatatcatttcttaccagctccaatccaaaattctgttttaattcatttcggataaatagtcaaattcgtcttcgaaaatatgatgtggtgacaaattaatacctaaaaaatgaaaaatgaaaaatttaaatttaattcctaaatgtgtaaaaagtaccaacaaattaatcatttcataagcgtgatgttatttgatgttatctcatgaaaaattagacttattgagcttgtttcgttccaagttaaacaaatcctattacagatataggatattagtattactagggttgactatataacctacatttgtactcatgtaataatttttcttatttgagtaaaatatacttttctctcttttctccccctgacccatgaattctaacaagcccttatcactccgatcgggatagacgggtccttgagctatttttttagtgaagggtgttaatgaaaatctttaagtaaaatagtctgtgaattgataatcaaatggagtcattacaaacatacgtctattagaatacgagacaaaaagaatcggaggggataaaataaaaaatgagaacatttgatcacggtaaaaaatcataaaaaaattataaaaattaaaaacgaatgttgatataattacaagataaaaaatatattcaaacctttggacaaaatctaagaagataatgtttttttttcttctctaattcaaaacttactttttttagtcacagtaccaaactcacaactcctactttaaccaagcacatttaagcaacgacctgcaaaaacaatagtaatagtatctgaattaaatatgtgttccagcttaggggtgttattggattaacttaaaaatggtttggatcaaatctaatttaattcaattaagatatgattataaatggattggattgtgagttttattttttattcgatccaatccaattcatatcatacattttatttattattatatgtaaattaattattaaatataaaatacattaatttttaactcataatttattaattattaaattaaaaaatccatatttttttctttttaagttattatttttatctctatcttgattttatttatattttcttatgttaatataaaactttatttatatctaaaataaaaatatcatattaacatatatttagtagttatatatttataaaattttagataaaaataaattattattctaaaaaaatatttttttacaaaatatatatatatatatatatatattcaaatatttagactcgattaatctttgaatagattgatttgaatcgaatttataaaaataattgttaaaactcaatttaatttgcaaaattttcatcagattatataatgaatttaatccaatcagattaaatcctatccgtaaacaccctatcgaaccataaaataagattagatacgctgttggttttttaaataaagaacaaagggcaaaaaatgcatggactgatgaaagcgtaagtgagagagaggaattggttttgaatttcaattttgaaggtatagtctatagtctatagtggaaggctgaatcaggaaggaacttatcctactagtgctgtctgtcaacgttactcacttcagaagcattatataatagaatgagccaaacaacaacgaaaacgcgttcacttcaaagttttattttaaaattaatattattaaaggaagggtacaaccaagacgcgttcaatacccattctattctatttctgctccctccatacttttccttactccactgcctattatttaaattacatagctcttagagtggaacaagtttaacgggtaataaccatttttaatcatcattgattttccactttcaattttacaatattaactataactattctttcccttaaataattcccaataaaaaggaaatgaactaacttgtaaagctttcatagaatgaaatacaattaatagcagttacttgcaaagaaggaagtcaagtgtcttgttttaacaaaatttaactaccttttaatttatttaattaaaattattttaactggactatactttatttaattaaattagttatgtttggtaaatattattttactaacttataatatttttgaaatgttttttgaatttgcgtttgaactcagtttttttaccttcaatattttaagaaacattttcatttatcactttttttaatgttatattattttttttaacaaaaaatagtttttaataccacattatttatttttattataacagaatttgactttcaaacaaaaagtaaatgcttaaaattaattaaaaaacaaaattctaattatctaaaaatatattttgtctactaaataaaaaattatataaatatactatttgatgtcagataatttgattatcaaatacagccattatattgtacaagatcctttaattcatataaatattgaatggctgattaaaaaaaaatcaatgataagtgaatagtcatgacatggacaacacaattcatgaacatactctttaattcattaactttcttgcaataatataattgtgtggtatgtatatataccttacgtgtttagattttaaagattctttttgttttttaaacagattttaaagattctgcatgtgcaaatattaaaaagactgtatgagataaatgtgaggtgcaatgatcttctatgaaaatggtcactttaaaaatgattgtgttcgcgcctaaaacacacactctttgcatcttcttcaaaccttataggctttatcgcccattataactctgcatattcatatccatgattactaaaatgaagttcgttgtatgcaaagattttgagctagctgcatttgaagatggattctactattctagttctagggtgaagtggcattaatttttatcattagatatataactaaaatattgggctgagattcaagaaaggaaactcacttaatcggttattttctaattacatttgaatgttttataacaattactttatttttctttatgtggtcaacttcctgccacccacagcccaccgccaccaccacctccttccagcactcacaatatgcaattcattccaaatttagtttccgtaaatgcgataagttattaaattcataaaattattttgtaattaattatattatttaagtatttatttgataataaattatattttaaaacattaatttgatattaaattataaaatttagatattaatttattattaaattatctaaagaattaatttctcacatttttatacatttaggagttaatttaaatttttatcttttaagattaatttgtcattctttcacattttcatagacaaaattaattatttatcaaaaaataataatatttttaaccaaaaacaattaaaagtttacccgttaatgaagttgcttttctctgacctctcgaccataatgtgaaaaaaacaacaaatagatcggtgttattattaaatttgtgaaaatattttattattaaatgataacaaagattaatttaataataaattttatttttaagttcactttaatattatattacaaaattaaagaatcaatttatcattaaattattcacgtaattaatctttcaaacattttattttaaaactaaatttaaatttacttttttaatgcctaatttattatgtctcataaccaaaataaaatattttaaaaataaaaagacctcagccattcaattttttaccactcacattggaagaagccgccgactttgaccaaagagaagaatgagaagaaaagtcacactttcctcccttcttcctttagctttcccgttgctgctgtgctgtgctgtgctgacaataaaaagggccacccctttctccctcttcttcattcttcgctcaatcgaggtcttctcgatttccttttctacaacacaacgctctcttctcttgcaaccaaaatacttgttccagtgtctactctactcaaaaaggtatgtctttctttccgtgcttttactgactcatacatatatatttttttttgttgggtgttcttgtttagatctttggttgttttgggtgggtctgaggaatatgcttcgtgggtctgcttctgggtagattaaagtttcaaactttggttttatattttggcagttgcatgttttcgccccgacccacctttcttccttttagttccttattaagtttattggaataccaagttgttgttgtcttggataggattagttatggatctaacctttgttggtaaaattggtattaacacgttttatggggacgttgcttagctttgtatctgtagggatttgaactagggtttggaaactctgtttctaaatttgaggttttatcgtttttctttattctgtgtgaataataaattataaattgaaaggcttattgagattacgttgtcttattctgcaggttttgggacatcatgtgcagtgattcgaaaagtaaactttcttccccaaccctagtcgtcatggagagtagtaacattcagaagcagaatctggatggtctctacaactcggttttgcttgaattgtctgcatctgatgattatgaggctttcaaaagagaggtggatgaaaagggcttagatgtgaacgaggcaggcttatggtatggtagaagaattgggtcaaagaagatgggatctgaaacgaggacccctctgatgattgcttctttgtttggaagcgctaaggtgctcaattatattcttcttgagaaaggaggaggtgttgatgtgaacagggtctgtggttctgatagggccactgctctccattgtgctgttgctggtggctccgaatcctcacttgagattgtcaagctcttgcttgatgctggggctgatgctgagtgccttgatgcgagtggcaacaagccggttaatctgattgctcctgcctttgattctttgtccaaatcgcgaaggaaggctatggagatgttcctcaggggtggtggggaaagagatgaactcatgaaccaggagatggagttacagatgttttctgttccagagaaaaaagaaggaagtgataataagaaagaataccctgttgatatatcactgcctgacatcaacaacggtgtatatggaacagatgagtttaggatgtacaacttcaaggtgaagccttgctcaagggcttactcccatgactggaccgagtgtccattcgttcatcccggggagaacgcgaggaggagagacccacggaaatacccttacagctgtgttccttgcccagagttccgcaaagggacctgccagaagggtgattcctgcgagtatgctcatggtgtttttgagtcctggctacatcccgcccaataccggacaaggctttgcaaggatgagacgggctgtgctagaaaagtctgcttctttgctcacaaacctgaagaactacgccctgtgtatgcttccactgggtcggctatgccatcaccaaaatcctattcagctagtggacttgacatgacagctatgagtccattggctcttagttccacatctttgccgatgccaagtgtttcaaccccacccatgtctcccttggcagtagcttcatctcccaagagtggaagcttgtggcagaacaaaataaaccttactccaccatcgttgcagctccctggtagccgactgaaggctgctttgagtgccagggatctggagatggagatggaactgctcggtctagaaagccctgctcgccaacaacagcagcagcaacaacaattgatcgaagaaattgccaggatctcttccccatcttttcggagccaggaattcaacaggattgttgatttgaatcctactaaccttgatgacctgttagcatctgctgacccttctgtattatctcaattacatggactttctgtgcaaccttcaacacccacacaaagtgggcttcagatgcgccaaaacatgaaccacctccgtgcgagttatccatccaacatcccttcctctcctctgaggaagccctcagcttttgggtttgactcatcagctgctgtggcaactgcaatgatgaattccaggtccgctgccttcgcaaaacgaagccaaagtttcattgaccgtggagctgcaacccaccatcttgggctgtcttcagcttccaacccttcttgcagggtctcctctaccctttcagattggagttcccctactgggaaactggattggggtgtaaacggagacaagctgaacaagctgaggaaatctacttcctttgggttcagaaacagtggggtaactgcatcccccatagcacagccagaatttggtgctgagccggatgtctcatgggttcattcattggttaaagatgttccctccgagaggtctgagatatttggtgctgagaaccaacaatatgatctcagtaaagagatgctttcaccatgggtggagcagctgtatatagagcaggagcagatggtagcatgagcaagggctgccatggcaatgcttcttggttattctgacaaagtttatttatttatttaattattttattcatttgaaatgcttctactatccaatattacaaaatatagttagggataggatgagatatgttgcaaagaacaaagttcaggttaatccagagatttgaacgggagttccaacttctagaagatcagggaagacttggagaaacgttgaacgaaggatgctgaatttttatattgtataatataaatttataacccccatttctctacggatggatgtattttctctagcaagtggaccccaaagtagttgtcattgattaagcagcacaattctttttttatataaaattgttatgccatttgatcaatgcttatccattactagaagtagtttcaagggaatttcttgtgtgtctgtttattgcctattctttcttatttaaatacttgattccttgtggtttaatggattcaaattcttcaaatataaatcgtgttcttatttagttttgattatattgagcttgtaggatctgtatcctcacggttttcccccctcaggccacacagagatctgtttttctcggcataatattcttcgtttgagattttttttttcctctttatgttcttgacggtttttttttaaagaggagttttaacacatttgtctctttcaatttctcccccttaaatacaaagagaggtcagccttttttgggtccagtaataacctgttctccccgccccccaaccagaacacaaataattaaaacatgatggcttctttcctgttgggagtttaaggaaaaaactagaagtaaacttacaaaatatgagctgacttgtattcttcctattttttttaaaaaaaatattctaaagaaactccagaagatcacttaatataaagaactttgaatgctgttttgttctttttttcccgaagggaaaaattcatagaaagcctcacaagtaaagagaataaaaaaagattgaaacacactgtaaaagatcaaacttacacacaatttcatgtcccgcaacttaatcaactgaggttactaaaggagagtattagatacttgataggtatggagttgagaatgagtttcaaatatttattgatttcttattttataataaatttttaaaggtccatcgatgaacagctgacaaaatgtttgaaaaaccattttcaatgttacatctaagggtaccaaaggaaaatagagtatgtcactttaattggttacagtagtactatcaaatattttagaaaaaacaggtcatggctaacccttcctttctggagcattagttggcacttgcaagttggaatgcaataggtaaaaaaagtatattcttaactgtaaaatttcttatgtatctcttaaattgcaataattttttcagccgttggttcaagaaaaaatttgtatattgtggaaatcaaacataagatttctatttaaataaatcgtttcctcacatttgaatacagctgagtcctacgcctttgtcaatcttgtggtttacatgtattccataggtgcaaaaaattgcaattatctgtacagataagatacaggttttataaaggtgtcgacgacggctcaataagaaaaggaaagagggttggaaaaaataaatggtgtgaaataagtctgcttcagatttattttaaaaaaattatgtataaaaagcactcccatttataaatataatacaagactttatttatgtatgccattatagatagatagattcaactttgaaatgaaggcaatgtcgggaaatgtagttatccagattagagggttatgtggcgaacagacggtccaatggtccttataggtagttgagtccttcagagaatgagttggtcttggtttagagtttgtttgttagttcatcaacccacgtgcttaaatttgtcaaggataatgtttagggcacattagcaaaataggcaaaaaaaaataaaaatgtatgaagtacattttgtataaatttgatatgatataaacgctgacatgatcggcataaagtacacacgttatgtataatcgttaaattttatgcaaatttgtgctgcaagatattaatataaaatcaagagatagtaaataattgaatatgctcctatcgtcacaatttgtgttatcttctaaactgaacttatttcaggaagtataatggcaaatgaacgaaaattgtataaataaaaacatgccgcacaattaaatttaaacttcaataacaaatgtgaagttaacttacataaatctagagatatgttatgatgattttctgcgttgtttctctatcacaaatttttttaatacaaaatcatagcatattagatctgcccatcagttaagttcataaaaattgtatcttcataattctctctcaagtgaaatggccatattttcatccaatttcatcaataaataactgttaacactctgatccgcattttccgctttaaagttcttagccatatatattaacaaagatagcatacgctccatatagcaaataagttgaattacaataatgggagaaatgaacaaactagagctgtctttccattcatttttgctttggagatagacttgctgtagcatctaggtactgcagctgcaagaacttcatgttggaaaccaatgagacaatagatataattttctcaaacattttttgtagagagactgatcacattcagcaagcaaccacatgtaggttgtcccatgctctcttttatagcagccctcaaatttaatttcatttaatttgtcataagaagctttgctatatatgttgaaacatttattcaatactttgaatacgaacaatagtgatctagatggtggggttaagaattgatgactaatttctcaatagaacatatatggccagaaaagggaggaatgatgaagctattggtacaaggcatgaaagataggtagttattttaaatcattgttaaactggaacattggtgattcttgcaagaaaataagacaaaggaggaaacagaataacaacttcaaaaagccttccactagctaggtgaaaaggaagaaacagaataaactggaaaattttcttgataattgattttacgctggggctcgttgtcctgcaaaccatattccctgtcacggtatctccaataaaataaaattaattcatgcataagttaaaaattatccttttttggaaagaagttaaacttttttttaagaaactaatatgagaacatttgcaaattagtttggaaaaaagtttatttaatttttctttcttattgtcttttcctataaatttgtatagaaatctttttctatacaaacccaaagttaccatatggtaatgttcaataatacaatctcaagggggacaatgtagcaagaggaagaagaaaagaaaagaagaataagaagggaagaaacagttggatatgcaacatgatcttagtaataatgtttctgatagtggaatcagtatatgcaacagaaaatgggctgaagaggggcgtatcttatgagcgggatgaaactgttatgaaacagaaaatggtggagatgaagaatagagatcaaatagtaggaagtgaaaagataaagatatgttatgaggagggatgcagcaagagtccatatgagactaatgatatacaatgagcaggggttgggggaaggattaagtgaaagtttattaggaatgtggtggcaaaggagaacattcaagtgttgtgcattcaagaaaccaagatgctggcaaatggtgatactctatgcaatgctctctggggggaaaatgaggcaaaaagtgtaacaagtccagcaattggatcagtcgggggattactttgtgaaactcggaaagcttggaggtagtaagttctttttgtggtgagggttatattggcttggaggggatttggagagacacacattctttagttactattgttaatgtatatgtaccttgtgagagacaaaagaaagttaaattatgggaggaacttactacaaaaaaaagggccactagcaatatcaagtgttggtgtatcttgagtgatttcaattgtgtaagaagaatggaggaaagaggagtgggagtgggagattataatagaagtgagagggaggctttcaacaactttattgaagattatgactctcaataaccttaatcgccgatttcaatgcatggatttctcttgccatgatctcattctgcaaaaacacccaaataaatacaggcagtgataccatacatcaggtaaaccaatcacggggaggatacttacaagtgacttaccttcttcggaaagtcttttaaaaagtttctgagactcattcacatgagctttcaaaatgggaatcggtggaatcttatgagcaagattgaacttaaaaacaaacttgacagctagaatatgtttgctcctgtcaataagtttctgcacaagatctgcaaaacaccaaaacaaaatttcccccacaagttaaaccaccaaaaattgtaacgctagaaatcaaataatagcagcatcaccatttcaatataaccttgcaccatttttttttataaaaaaaattccaacttcaagatcacgtaacataaacactagggggttaatgatgttttaacaccctgaaaatgggtaatctttagtttttgtccgtgactttcaatatcattagtttccgtccatgtgttttagtcccctaaagctaaaattaggaccttgtgagagacaaaagaaagttaaattatggtattaggggataaagtttggatattggctaaacataggcacgaagatcttaaaagtctgggcctaaaaccaaagatccattgttttaggaaataaaaacgccattaaccttaaacactattgtagcaacaacaacagttaagaaactataagtacaacaaaaaacaaaaacataaatatcgtttctctaaatatttgtataatattagtaattttcatgtaaatatcaacataagataacaaatatcacaaaaaacagtaaaaacactaactttagttaattttataaagattaaaacaaaataagtgcataaataagattaaaatgatctttttgtggttttataataaaaacaaaactgaaaataaaagatttaacaattaacaaaggtattgtcgggattagacttcaccaaactctactttcttttcactttaatgcacaacacatattccatttgtatttcaatgttaaaatcaatcaataaatatctttgtagctctgatcccttagatgaaaaaagtcttaatttctttattaagtcttgatccctcaacaacttaagaaaaatgacacaagataataatgaactaagcttcattcctaaacaacaagttcattgggtattttgtttcagctctatagaatgaagacattttcaacaacaatcatgtcctaaaattatgtcatggttgaccattccacaacaagcattaaacaaagaaacaaaatattaacattgaacacaaacatacatacatacatatatatatatatatatatatatatatatatatatatatcgaaagagagagagagagaaaaaaaaattacacaagtgtaactttgataactattacatcattctataacttataactgaataatgttttcttaaaactcattgtttgattgaaattttttcccacttatatcacatatgcaaaatttcatattaattcaaaatcatttgttatttcgttcatatatactaaaattgacttaatataaacatttcaaatatactaaaatatgaataatttgattacccccttggtgttgtttaattttgacatatacaatcttaataatatgtagatataatttaacgattgaataaaaaaaatcacattctatatcaaattataaaaatgatgtaaaaattgtcaaaattacacatatataatttgatctctttttatatatatatttaccaagatgtacaagagagtttgagtaatgtttcacctacttttaacaatggagaaacttagttacttatagcaatgagtagctccaaaatacatgaaagatggaagagaaatggagaaaaggacccaagggaaaaacttatctccaaaggaatagtgagaacttcgtgtctctagacaaaagaaaaaaaaaatgaaggaccatcctttattagacaaacatccactttaaatacataagaaaacttttcatttttggcaacaattttcgcttaggcataaaatttggtttagttagaatacatagatctcaaatgaacacaacaaaactcttgctcagccatcgattcttgcttagtcaggcttgaaccttttgttctctatctgaattttagcttagcctaaaattatggcttagtaactgtaacgcatttccttacattttttcaagcttttgctcctaattttctttccaacttcaacctctatttctacaaaaaggaattagaaatacaaagataactacaaaataagacaaccaactaaaaagttaaaactttataaaactagattaaattgagtttaacaagactccaaataagaagaaaagtgagatctctaaatttactcacaaattaagtatcgtagacaataatcagatgcacaataccatccatctcctaccagctcaaataaagcaaaaaatcaaattcaattaagggattgcaacctggaactaaaaccaaagatgatcctcacacaccattaaccctaaacactagtgtcatagcttacaacaacagttaacaagctgcaccaacaaaacaaaaacacacagttacaccataatatcatctcctaactgttcaaatataacaaaaaattaagggacttcaacctgaaactctgtctcatttcatttttttttttttaaattttttttctccaataaatgtttatgatttatccaatcagacactcaaagatgactatttttcaaggactaaaaacaccaacaatcctaaacactagtgtcacaacaacagtacggatatgaattgggccataatgcttgggctgctatgccctgatccagtacggatattaattgtatattatttggttaatatataattattgtagtataaattttaagaaataattgccgattttttgaaaactttctcaacaagttaatggggaaaagttcccctaaaataaactgaaacaaatatacaattaccaatttaccgtaatcattattggaaatcaaatcttgagcttaaagtgatgatccacttttcttttcgttcgttggcaaatggcacctttggtgattcaaggcctttcatgcatgttgaaagggatggtcatatgatacaagtaattaactcatggatgaatgaaagggctacacggacttaataactctaactaaaaatagcatttccccataaaataggacaatttccaatgaaaagaatcacattattcttacgttgagaaaccatacggaagattttggaaatgaaagttattcacatattttggaaataaaagtcatcttcacgcgaagcacatcacaatattttggttaagatattttctcccataaatcacagcaacaaagtttggtaaaatctttttaatttcttttcaatggtgttgtaaagccagcaaccaattaattattttaattccttttcaaaatatttcatcaaattgaggagtagaaatcattaatcagggaaattaagatgcatagaacccgcaatgattttacatgatcttggacaatccctccatgcacgggatggataaagtcgaagtacaatgttttccaataattttaatatcttattggtataaatatttgaaataatattacttgtgtttagtctttgttatttgagccacataagatttcattcaataataaaaagagttaataagattattagggaagcaataatccaaacgaataaaaatttaaagaaaaaatcttcaaaataatatatggtttgactgatataaagcattatttgctttatttataagaattatttgttttcaaactatatcatacaattactatatcaaatgcgattcattcttttataataatattttactgtaataaaatggaagaaagggcaagtggcattgacgaactattgttaacttcaaactattacttataatatgcttagtcaaaccttaaattttgaaattttttttagtcaaactactaaaaaaaaacttatttaccgagaaataaattttttaattagtaaaaaaaattaaaaactaactgaaatgctacttaaagaatttttttttttattttcagttttaaaataatgttattaatattattatttatatgttaaaaaatgttttaagcaatataataatcaataataataaagtttttttaatttacttttactttttcaaaaacaaattaaaatttaattgtaccattttttgtaataaagttcaaaataccaaatacattcttttacatcatttgatatttataagtcaatttatcagttaattttattaaatacttttaattagcttataagtttttaaataattttcaacttttcagtttataacttataacttataaactttcaactgattttattaaacatagtctaacatacacgttattttatatattgataattttataaaaatattaaaatttaatttaaaataaagataaaaatgataaattaataaaaaaagttaaaaaaatcctttaaaaacattatagtagaaaaagttttcttaaaaacacaagttttgttctaataataagattaactttttttctcctcaaaacaagatatttctataatcgaaagtcatgagactaatcatgagactaatcatcgaaacataaaaatccgattttatctctcccgatatgttttttttcatatgcaccatttgagaatctatctctatgaacatgtttaaagaatcaaattatctactaactctattatatcttattgatagatattttctttctacttacattgtttaaatatcaaataatataatcacttttatctctcagttttctttcttttttcatgcacatagtatatctgactttaattgttaactcttttttcccccagttctctttacttggattcctgtcaacagcaagagaatgtgattctgaagccacaacctgattttgttatttctttctaatgttttcttttcttggaaggtaacctcttccccattacctggaaagctattagaagcacctcaacacgctcatccatcattgtttgccccgcacgcgctgccgtcaaagccttacgcgttgacccacaaaacaaaggtttatttgactttcctcaacacccaaaaaacacgatgcaaattgcaaacccgtttccttagttcggcacttcggctttaatattattaacaaatcttcatttacattttttgatacagaaagtatcaattaaaagtaaatatattcgatatcttaaaatacttttttttatgtttaataaatagaaagaataatacaaagatattatagaaaattcaaaaattattctctagacgttattataatgacataggaaaaaaattctctttcatttattggaatttacccatagcagagatatagacacaatgtcggaaaatttcactaaaatgagagaatctcaatccaatggcatatacatctccaatgagtcatgacatgacaatgatgagtgtggttaaaagacaatcaattcgtttgttttttttttttttttattaatttgtctccctaatcttttatttttaaaagtcattgaattttaagtaattcaagcagagtaaaataaactcatttttaaaaaaattctactcaaacttctttttatttacaaaatttgaattgaatacgtaatctcaatttaaaagaatcaagtttttttttgtggttgatataatttttaaaataatttttaaaaaatcaactaacttttcatgaatggtgagttttgttcagatgatagtatcaaattatttttatatttgttactatacaattttaaaagatatagaaaaagttgaattcgaaaaaagataaaataatgatcaaagaaaaccgtcaatactttatagtttgaattaattactcctcaacgctgcatctttaataattataaatagtcacatttacacgtctctgacctctcccctcattttttgtgtctgatttgaggttggagcgtagtcagcttctcttttctgccgaaagctgcagaattgtgttgttttctctcccttgggggtcaagcaatcggttctcttcatggttatcaatcttatccttcttctttcatgcattatattcattcatttaccattcttctcctaaacaactcacatagcccaccagatttgaagtattctgtgtgtgtttttctgttttacttatataaatatctggtgagaaattattgtatggtttgatattactacatgtttataagttcagccaatattcatatcacacataatcgaattttattatctctttttagtgaattgaaaaacttgttcacatggtaagagaagattgaccgacatgaaaacgtgatataataaaaatcaatgaattaatggctagacttagttgcagaaaattattttttgattgatttttctttgataattttcatctgaagacttcaatggggttgttttgttattgttgttgtttgtttcctttttcttccacaaaatttagtggcatgctgaatttgatttgatatgattagattttgccgagtatctgattggtcttacatgtgatagatgccgagtgttaaccctgacaaagattccgagccatttgttgagaccgatccaactggtcgctatggtagatacagtgagttgcttggatgtggtgctgtgaagaaagtgtatcgtgcatttgatcaggaagaaggaatagaggtggcatggaaccaggtgaagctgaggaacttctgtgatgatcctgccatgttggataggctttactctgaagtgaggttgctcagaggcttgtccaacaagaacatcattgcactttacaatgtgtggagggatgagcagcgaaacactttgaatttcatcactgaggtttgcaccagtgggaatttgagggagtacaggaagaagcataggcatgtttcgataaaggcactaaagaagtggtctaagcagattttgaaagggttgaattatttgcacttgcatgatccctgcatcatccacagagatctcaattgcagcaatgtgtttgtcaatgggaatactggccaggtgaaccattttattcaaatcttattttccgtccagttatatatcatatatgtttgattgattatcaaggtgaaagtaaactaccaaaaatgcaagaaaaagttggattttttttcttctttttcttaactttcctttgactcgatgccttctgtgtgagatctaagtaattaacttgagcaagtcatggatgatgtctcctgtttgcttgacaaaaacgatcaattacattgtttttagaatactaatttggtgcttacttttttccttgctctgtttttgcctataaatttctactatgaaaaaatatgagaggtgaaataagtgatgcattaaaactataatagggcaagaagatgggatagcataagaaacaacacgaataatggaaaattgaaagtaaaaaaccataatagtctaagatattttgattttaaactatttttggaaactattcttatcaaacatttttttggtttagaaacttcaaacttgtttgcctttagccactattacaaccaaggttaatcttagttatgctgttgttatatatgtaattaacataaaggttttgttagtgattgtatcttttttcatggatatcaggttaagattggtgacttggggttggcagcaattgtgggcaagaaccattgtgcacacacgattcttggcacaccagaatttatggctccagagttatacgatgaagactacacagaattggtggacatatactcatttgggatgtgtgtgttagagatggtgacagtggagattccttatagtgaatgtgacaatgttgctaaaatatacaagaaggtgtcttctggagttagacctgctgccttgaacaaggtcaaagatcctgaggttaaggcctttattgagaagtgccttgctcggccaagggctaggccttctgcagctgagcttctcagagatcctttctttgatgagattgttgatgatgaagaaaatgatgactgttcttgttcataccaatagaatatttcttacagtgttgatttgatatgtgtgtgtgtgtgttttttttttaaatttgattcacctaccttttcagtatgcaatgtcaatttgggcagcctagaactgtgaacataaattgtttatatattttttccatttggctagttgtgaaattggataaggtttggttgaatatgggggttaccaggggagggcttgattggggttggtgtccttttgtttttgtacataggaaattttacagatgagttgtgcggcatacattgaatgatgatttgatttgacaatatatgttaaaatagtatattagatgttatcagcagtcaagggatgtgtgatggaataaatactatatcttgaaaaataaaaatagtactaaagatgtaatcttagaaaggaaattgtataaaaaaatataactgtcccattttagaaggacgtgattctagtaaactaaaggatatgtattaacgatttcatccaaatataaaattacattttaaaaactattctcttcatccttgaaaatcaaatcctttatgtactttttattttatcattttgtagtgtacaagatttattaatctttttatacaagtttatttaaataaaccctaaatttaccatccttaagaatgttggaatatcaaaaatggtatttcaatatttgaatgcttccttttattgccaccttcaataatggaaatgagatattggaagcaatcaaaaacaatgtcagaatgaaaagggttttatcgtttgatttgagggcaaagaaaagtgaagtcaagggtttgaacgcagtttaagcagcatgatatatgttggaggccagcttacatataataatcacaacaagcaaaatgagttgttcatgttttaaaaattggtccaacggctaagcttaatgatgaagagaagtaggtgtgaactaaagggtatttagacttgtatcgtgcaaccccactcatttttgttgtgaaattaatcaaattattgtagtgacccgttgggtgtaccacatcttttttctccttaaaccaataaggaattttgacattgacttttcttattgttttcaatattcttttatttgagggtacgaatccaagcattgtactttgcaaattcctcacgaatgccaaagaactactacataattcaacaacaataaaataatatcattgccaaaagaaaataacacttatcagattcatcttctgcaagagcaaattggagataaagacaagtacaaggtggttaaacaaccttaggggcaatttcaatggaagtttgccaatggaattatggcaggggaatatattccattttaatttcgttacgtttgatgttataacagcgattgcggtaatatcgctcatatattagtacttcatatcatgcaggtcaaggtagatagaggaaatattttttgcagaggtggaaagtcaatgaatgtttattttcaattattaattagttgttcatgtataatctaacatattcaaggcacggcacatgctaatgctacaattagtctcctatctatataaccaggtccatgacagctatttgccaaaaaataagatttttttttttttgttttaatgtaaaccagtttaggcaatacaaatatataaaaaaaatacactatttcaaaacagattgcattatgtagttcattaattaaattttatgacattaatgataaaaaaaatagttgcttttaagaactaatttattgtgaatgattttcttgcaaaaattatattaaatttaaaagtgcgatcagagtattaaatttaaatttggaattaatttaattactttcacttatattgatttgatttagaaatatccataatgaaaacttataaagaagataagatttgaattgatttgtaaattaaccttaatatttggatcaccttttttttttaatcatatttggatcaccttaaaaatggataaaattattattttaacaactttatattatatcgtacttacaatagataatcataacatgtttaaattaatagattagtaaccaaattgtactttccattcgatgatatatgtagcaaaattatttatatttagaaaataaataacttgtttaatgtgttgaattttacttaaatttggctgaattctgattagtctggtctcttttctccattgttcggaggtttatcattatgcacagttaagaggaagggatatgtttccggatttgaacctatgaccaataaatcagcaagatataactttaccgttatgtcaggactcgtcctcaatcaaagataatatcagaagatttataataactcatacactatattcaatcgactaagttaaatctcccgaaaaattaacgaattttatattaaccaattgttagaagtagaaggtactgaactttttggtatgcaagcagagttccagggaagtgtacacatgagataagatatatatttcacttggcttgtgacaaataatactcacttccataatctctagttatgcaatttaacgtgctactcactaattctttcttatgcaatgactcagccgcatactcatgaccacagtcccccacaacaaatataagagttaaaaaaaagtggtttaatgtactctgtcttctattattttcctttcctttatttactgtgtctagtctcttttctcccaaacaagagttctgttttcccccctttctgcgtcatttattgcgtttacctataagacatgcaggatatgatgataattgataagggttaagataaaaaagggaaaacaaaaaataatagagtgaaaatcacctatgtatcaaggcactcataatgtctataaacactctcaattttctttacaaatcctagccggcacacctataatcgatgtcgtccaacattcacccatattattactcaaataaattaattaaaattattcattcttatgtgttaaatgaatatatatatatatatatatatatattgtcaaaataaaaaaataatatattaacgttttggtgctcacatcacatctataacagctttcagcacggttaatgtttttaatatgtttggtttagaatcatgttctccagatccatttttattaactcttatatatatatatatatatatatatatatatatatatatatatatataagagcattgctatttttgttaccaaagaaacctcagtacaaattgtaacgaaaagtgttaaactaatgaaaaaagtgttatatattaatagtataaaagttttattatatgtatctaattataatttgtgattgaataatattttacattgtcagtatcttgataataaactctaatctagttacgatattatttgtcagaaaacaataatgataatttgaatagataggcaaataaaaattggccttgtaacatttatatcaatttgtgcattttttagtattaaggattagttggacttttgatccctcaagtatcataattgtacaatatcaattttaatttttcagattttaaatgtgtcaattaatatcgaattcctcatgtattgcaaatatttgattttaatcctcaaagtatatttattttttctttacccccaagcgtgtgtgtatatatattaataagaatgatgttgttctattaaaaaaaactaaaattgtaccattacaatgttagaaaattcaattaaaatttaagaaacttaaattgcacaattagtcaattatgatcctagacgatgacgtgtgacaaacctttttatcaccattggatttattatattttaaataaaaggctgtgattttactagctttatctttttattttattttatcaactttcccaaattctcgtgagatcccttctctctaaccactatcgtgcaatttctgctcgctcacaataacctgaaagctgtaagaaaaaaataaccatacaatacaggtgaaagaagaagaaaaaaatgaaatcttaccttacattaaaaagaataaaagggaaatttaataaatacttaaaaaacataagatgagtaaaatataggaaataaaaagctaaagtttcacaaatgattactagaagtagtatctcaaaaaaacattacaatatactactaacaaggttaaataaggttttcaacctcaacccaacatgaaaaaacttacaaaaaaaatctcattttaataaataaaattcatgatatccttatttctaataatacttaataaaagtaataatactaataattatccagaattagagaaaaaaaagagatatattttttcaagctaataaaaaaaaatagaaaactaaccgaaatagcgtttcgaacataacggtaaaatttattttttatacttatatatatatatggggtaggtactgaaaagaaaaggtgaatattttagttggagaacagaggatcaaaactcctatctacacacgctgtaaaattttgaaatcccttgtacaaacacttccttagtttatagtaggatagatgcttcatgacaagagttatactgataccttgcaattatgttgtcaatcccgatatacataccattcatcaattttggaacaacgtgtaattttatattgcatgtagatattaacgatgtaccactaaaaacaagtattacacgtatctagcgaaaacttctaagaagagacatgtctttatccaatgcacaaataaagaagattgcaggactaacatgattctctcgcgaaacccttagctacagaggagaaagccaattggagggggtgaccacaaaaaaaaatgcagaacacaagagattttgctgtgtttctaaggaggctagtttcctttgctatccttattttctttatagtagaatgtacaagaggtgattcatcagaatctgagtctttcttcaatttcataagggcccttgatcccaaaaacgtgcttaacattacctggattgagtcaccatcccatccatgcttggtcaagttgaatggtgtaagatgcaacttaaatgctaccaatattgtacatataaggcttgataacttgaaccttagtggcacaatcgatgcagattccctatgcaggctccaaaagttaagagtggtaagcttggctaacaacaacattagaggaaccataccacactcaattttgcgttgtacaaggttgacacatttaaatgtaaccggcaaccaattgagtgggaggttgccaaatgccttaacaaaattgaaacatcttaggaacttagacatttccaataacaacttttctggtacgatccctagtaaacaacattatattcacctccttagttattatgtgactccaagtaacaagttggaaagcaatagtaccaaagagtggctaaaggaaagtgacacaaacacaatacagcaagcaacgccaggtcctttaagcgacagcacacctaataatggcaagaatccacggccagaaaccttgggggtgatacttttgggtgctggattgcttttgtcaaccatttactttattgtaaagaagtcaggaaaattaagtgcagagagagaggtagttaaagaccatcgtcgtttgtctccaataacaaaggctacaactcatgaagttcacgaggtgaagctaaaggaaggagattctgagcttgttttctttgttgaagatcgtgaaaggttcacactcgaggaccttcttcgagccaccgctgacttgaggagtgaaggcttttgcagcagcctttacaaggtgaaattggaacacaatgttcactatgcagtcaaaagattgaagaatttgcaggtatccttggaagaatttggtgaaacattaaggaagataagtaacttgaagcatcagaatattctcccccttgttggttatcgttctaccagtgaagaaaaactcatcatttacaaatatcaaagcaatggaagcctgcttaatctgttaaacggtaagttaagattaatttgtttttcatcagctgcaacactccatatcatcttctctatttgttccctaacttgtgctgcacgagtaattatgtttctgccttgatcatttgaacaatctagctgaaaccccacattagtacattaatataaggcaaatgctaataagtgattaaaaaaacaaagtgattttttttttatcaaaagtgaaacatttaatatatcatgatataaaagttatttgacacttaattataagtaggaatgactttagaatatacagaattacagatagtgtgaagagtttttacattgccatccaatcatgaattgtcatgtataataagattgttgatgacttttgtaataagagtcttatttctaattggttgatagcataaacacaccaccaatgtatcaaaactaaaagtaattgattttttttttttttatgcagattatatagcaggtagaaaagatttcccatggaaaatgcgtttgaatatagcatgtgggattgcaaggggtttggccttcatatataggaagttggatggagaggaggaggtcattcctcatggaaatctcaagccatcaaacatccttcttgatgagaacagtgagccactaataagtgagcatggcttatcaaaattcatggacccaaatagaggtttcttgttttcctctcagggatacacagctcctgaaaagagcctaacagaaaagggtgatgtgtatagctttggagtgattctcttggaactactaacaggaaaaagcacagaggtgagtagaatagaccttgctagatgggtaaggtccatggtaagggaggaatggacaggagaggtatttgacaaagaggttagggaaaatgatcatcaatgggcatttcctcttctcaatatagccctcttgtgtgtgtcacgtttccaagaaaataggccaaccactatggagattttggagaagattgaggaggtcatggatcaacatgaacaacatcacgaacgttgtgcttccaaatgctgttccattggatccaaccacgatgagtgttgttcacttcacaaaatcatacctgaaacgtgggattctccaggatcaaattattgatttatcttcatgctccctataataacatgtattcacctatttatatatcatagtgattcctgtgtgagagcttttctaatttagtcccacatgacttagaaactatgggcattatctagtagaaaaacatgtgatactttgtagtcatcggtttgttataaaggaattaatcctgtattctggaactatgcttttgaacttgattagatacatgttattttaatattttgttaattatgaattttttaactatattttgctatataaatgtagctatatatgcttcaagttgttgattatatagacaacaagcaaaagcagacaggtgttgaaataagtgtactcaaaattgaatttgtttaatcaaatgattaatgtgctgaaattaaagttgaattgtttaaataatatccaaatttgatcatttgtcaaactttacttatcttctaaaatatacttcaaattagtcacaatttatttctcttgatgaaacagagttaaagaccaaaaaaattgaacttgtttatcatgaaaggacaaggaaaagaatcatgtacattccatctgaaatttcaataacatatctgtagaatacaatgatgttacctaactcttaatatatgctaaaatgctaataactttttattttttatttatcccaaaacaaaagagtgtggcatggtggaagccctactgaagctacctggatttgtgggttttacttgaatttttacccacctgaacagatgaataatgataagcatgtcatgcgattgaaactcgtttgggttgatttttcaaaagcaatgagcgtgtgcggatgataattactgctacaaaaaagataaagcaatgaaatagttaatcgaagaataattattatgtctccttgagtcagttcaagtgaaattgtgaaacataaattctgagtacaggaattcgatctctgttatatatttccccttctaaatattttaacttcagattagcttattagaggcttttaatcaatttgctctaacaggtttatctatttggcatgtccaatccatataaatccctatttgtcttacctcgtcaatcaaaacaaaagcaaattggaaaacttaagggaaaaataatatgaaattcctagaataaaacgtattactatatattttttttttggcataaatatttgtgtgaaaagttttattattaattttcatgtataactatatcctattatatcccgattaccaaaaagtttaatttttaatatgaaatatttatgtgagaaattttatttactttttataatagtgacaatggagtttaaatctagaacgaaacctcatgtaaattatctaaacctgttactatgaagttgatccgagtaaaagttttattattattattattattatatgaacatgatgactttatgataccaaacttctgaaaaataacttgccaacaaaatatgaaatttgaaggttgtgtaaaatgtagagagtgtttagaaaagaaagctcaaggaaaataacatcttactatgaaaaagtccaaaaaaagagcgtctcaacagctgaggtctaagttgagtagcatcaaaggcttccaaatcctaaggtcaaacttgggtttccctctgctatttattggtcttcgcagtgttgattcaccgcttaaatgtgcttacgttttttcaacactttaagggttttttttttcttttttcttttttccatacacttgaatgttctagcgtgtaggaactgtgccgcctagtgggctcatactgcagtaaaagaaatccaacttggctctttacatgggactttcaatagcattattcatggtcgtgcagcttcggggattaggggcagcatctgctgtttggctcttgctcttgcttctactgtttattgtatttggtcatataggaactctattatttttaacgggcacgtttttaatctttctgatgttgtggaaaagattaaatttcgtgtgatttggatgagtcatttgtcgcacttgtattagcaactcttttgctttgattagttgcttctctttgacaagtgtaacagcttttgctgtttgattctaccatgtatgtcctgtgtattttgtaagtatcttattggttaatatactcatttacatattttcccaaaaaaaaagaaatccaactgggaatagaaaggcctttagagaagaaaattacgattatttggttttaaaaaaatgttttattttttattttcatttctactcataaagtattatactttattttttcttcttcaatatttcttatataagcttttaaaaataagaaaaagaaaaatgaggtcaatgcgttatgattacgtagtacgttatgatgggtttgttttggaaaaaacccaaggtaaggggttactccagattcagcttcaaatattgcgatctctgcctaagccttttagagtagctttcaaggtgtccataggaggaaccaactgatcataggaatgtggaaaaatatgttaccaaccagtctttccgtgttcttgttttccttcatatgtcaacttggtgtaactcaacgttgagtgttcacgtagcattgcataataataataatagttattagacatttgttgttggtttttcctttgtttataggaattacccgtcggtttgagctgcactttcagttgttaccccatcaaaactctcaatcaaattttaaataaaataaacaaaaaagttgatgctccatctactcccacaataacctaacattttaattcttttgttactctatctttaaaacgttgtaataatctgcaacatttaaagctcattttgaatccaaagcatgaaaagtagttggtgtgaacaattttagactctttttcttaaataaaattttgagtttggatcttgtggagattaaaaacgtaattgaaagaaaaaattccattaaaaatgataataataagtcaatatcataatataaaaaaaattacaagaacaaaatcttaagatatcattatttgtattaacatcatgatcatggatgggtaaggatattaaagctgaacacaaattttaaggatgaaaaatgcttactatcataaatttaaaacgtttttttttataacaatttaaaacgtttttatctctgtgtgtaatcaatacgtaaaataatttgaagtgtcacgtaacatattcttattgctatggcgtttcctatttccaatccgatgattccccaccccccccctcctcctcctccctctcctctcctcctcctcctcctcctaagtatgcatatatcattccatatccaaaacaattaataaattatatttttttcacttttacaaaaaaaaaaaagttatgcaaaatctaaaaaagacgattttgtaccaaataatatgagctaaatcacctacaaatattaattgttcctcgagagtaaaactactacttcaatatgcattttgaagtaaatattagtccaaattctttgaaacaaatatcatcatttcattcgttatttccagaacggttttgcattttgcgagctgttagatgaaaagcatctccaattgaatttcctctttggaacatgatgccaagtaatggaaagcataaattagttttcttaaatatatataatttatacagagaggatagtaataaaatatctaatcaaatttgatcctatataataaatttacattttcatttttaaagtcagatattttttgtgtatatttttctctttccttctgtaacacatgtcaaattaatgtccattcagcaaaaaaaaaaatgtcaaattaatgtttttccttttaattaattattcacttaaatggtacatgtattcttcctatttttttcttgttacctttttctttttaggttggatttgctaccttatatctatataaaatataaaatatatcaaattaataattactataacaaacaatttgttcaacaactccactgcatctatatatattcacattaatttattttatgaaaattcatattatttatttaaaagaaataagtaattaggtgatttacattttccctttatatatagttgaatttatttaattttaaaaataccatgatctgttgtcatttgctggctcctccaaatattcttgcacgatttgcagtgtgtgtctgtctgtctctctctctttctctcttaaaatatatctatttatatataaatagtgaactgtgttttgcccatctttgcttcaaattccatttcttttgatttaattaagagtacctagttgaagcaagcaacaagataagaaagcaaaacaggagagagagaggatgacaccacatcctctgttttcattctcattcttagttttccctgccattcaaattttcacatgacctctcattatttattttttattattagtttcttttgtttccatcaccaaccattcatctttggatggtgaattccccatctgggttcctctctttttcctttgatctcttcgccttctctcaatttcttcttctctgatcccagaaaagaaacaaaaaaacaaactaaaaaaaacatttaagaacatttttttttataaaaaaaacatagctgcttggttttctctctttgctggattagatattttggttcagttttttttattgatgctccaaagatccgattctcttagatcgaatttggcataacccacttcgtatctgattgaagcaccaactgggttctgtctgagattcaacataaggtgacccttcttcacagatttatctaatctgcatttctgatcgctttgctttgtttttgctcatgaaaaattgaatctttctggtgatttagctcaattatgcattattcaatcagctatgcatttagattggttctgggactggaactttgcccatcactgaataatatagaatctagattttgtgtattggaatttctaattttttttatgttatattgttttttggtttggcatgagaattttgattcaataagaatggttggattggatttgtttgatgaaatgagtgattgatggttaactgggcatggttggtgacagaacagatggagtcggatcttggcaagctcttcattgggggaatttcctgggacaccgatgacgaacgtctgaaagaatattttgggaaatatggagaggtgatagaggctgtgatcatgagagatcggacaacaggccgtgctcgcggtttcggttttgttgtctttgctgatccttcagctgcagagagagtcattatggataagcacataattgatggccgcacagtgagtttttcatcatagatttgttaagcattatttcaatatacatgttatttggatgggcagtgatgggacctagctaaatttatgtttctgatagagatcattgtgtccctacttttatattttcttataggacaggaagctgaaaatgacttgcagatttgatccgtgtgtgttgtgctgtcaatttgcaggttgaagctaagaaagctgttcctagggatgatcagcaaactataaacagacagtctggtagcatccatggatctccaagtcctggacgcaccaaaaagatttttgttggaggtttaccatcaacaatcacagagagtgattttaagaagtactttgatcagtttggtacaattactgatgttgttgtaatgtatgatcacaatacccagaggccaagaggttttggcttcatcacttatgattcagaagaagctgtggacagagttctttataagacatttcatgaactcaatgggaagatggttgaggtcaagagggcagttcctaaagagctttcccctggacctacccgaagcccattgataggatataactatggtttgaataggaccagtagcttcctaaatagttatgctcagggtttcaatatgaatccaattggaggttatggagtcaggatggatggaaggtttagtccacttactagtgccagaagtgggtttaccccatttggctccagtggttatggaatgggagtgaatttggatttaggattgaacccaagctatggagggacttccagttatggtggcggtcttggatacgctcggatgagtcctttcaacaatggcaactctaacagatataccactcctattggcaatagcgggggcaatgggagaagcgattctcttatgaactcagcttcccggagtgtttggggaaatgggggcctgaacaatgctgccaatagtccagtcagccctggcgcttacttgggatctggaagtggggcttttggtgtttcaattggaaatggtggcaccaattggggtccatcagttccaacccagggtggaggggctgccactgggtatagtacttggggtaactcttatgaaggtggagataacagcatcagtttaggaggtggagggtatggaaggaacagcagcccaagtgtgcctcaatcctcaacatttactgcaccaactggtgattatgaaggatcctatggggatttgtaccgcaatggttcagtttatggtgactcaacttggcggtctgctgcttctgagatagatgcttctggttcgtttggttatggtggacttggtggtatagcttcagatgatccagtaaagagttctgagggttttattggaaactacaatgtaataagtagacaaactaatagaggtaagatctttggctacatgcttgtctcatgtagaaaattagatcatagtttatacattgtctgttgtttattccattttttcataaaaccaattgtgtgttttggactttctatgtttcagaataggaatattactgaagaaagttgaaaactaagtctgtttattttttaatgtgctattacatttgtctttaagcttatgatcatcatgttagaattgtgaatatagataaacataacatggaagcattattcatgtcttttgattatcccaaacaccctaggttcctgactttattgacatgtttcctttattcctttattcttgatgttgtcattgtaaattcttactacagtctaaaagtatattagggcctctgtggtttgtttgagaaaacattttatgttctcatttcttattttcgcatgtaattactaaaatatcacttaatttttactttatgttttcaaagatttatataggaaatagtgaaaaccactgagaagttatattttctataaaataaatgttttcaccatttcttgtgcaaatctttgaaaacaggaataaagtaaaaaacaaagtggcatttttttaattattagtgaaaacaaaaagaaaaaaaaaaaagaagaaatattctcaaaccaagtatgcccttagcttgctgtaataatgcctgagtttcttgattactttcatttaaagatattcaaatttgatgtttcatgtgaagttatactaacttgcaagatgctagagatgtaggcatagattactcactcttgttaattgagtatgatgattttctcaataattaggatttgagagcttcaaactgtaaaacagaatatagacatagattacacccctttgattcgttagtgaaaaatgaggtttgattatactttcttgtattatattgttgtgaaagggttggcatttgagtatttccattacgtttttttacctgttctggttcaacttcattgaatactcattttcttttgttgcatgtctacttgtttcaggaattgctgcttaggagatatgttaattggatatgttatggtaacagtagatcaagggaaactgattaaaggtgaaatcatacggaagctaaatcagtcacaagtgtttttgtgtaaggtttgggatttttgttgtctttatttttcaaggctaggttcctttcttggaatttgattgaggtgtaacatcagattgcgggatatactcaggaagattggttccagtagtttaattgtgcattgctggagggatgcaccatcatcgttaatatgcttaatgatagtttattaatttttgatttttttttttttttttgccactgtaatgcttggcaaagctgtttgttcttgtcaccatctttttcatgggacatgtttctgatcaaattgtaagtgaagttctgtttgatttatcaggtttgatacattagaggggtacccatcttggatcccccatcaaataattagttactggacagatattattttttgttagacttttgttatacaactttatactttggtttattgttacattcaaaatttggttcctgctgatattacgactctattcataatagttgctttctctcctgtttggttgttgtaactttgtggtgaaaatatcgagcatgctatagcatctttttatggaccaaaattgattggttaaaataagggagcatggttcatttttttttggtagcttatgtttgtcaatagtaaatactaaatagtaacttttttagttttttggttgtttcttacaattccaatttggatcttaagatagaatttgtgtgtggtcatgctaactcttatccttatatggatcatgatttgtcttgtatcactttcagttttcccctgaaaaccccccattacaatgtggtcctctctctctctctctccccacagaggacacacaaaattgtatataactatatatatatccatagtcttagctattaaacagcttatattaacttggatgtgcacaattattagtacaatacttgggtagaatatcattattctaagccatgcaagcctgtgttggagattttagacgattgtcacatgcaaatccatataaatgcacatgcctcaattatgttgaaggttgtggttgtagacatatggtggaatctttattaatttgaagacaatagcgtgtggcaaactggcaatgacaaaatcatggatgataacaatgtttcgtttcagaactccttggaagtttgaatgggaaaacaatgcatgaatgaaattgaggctctatagataaggatgttggggatattgaaatatatgataccataactattttcaaaagcaatatgccttaggctaacatcgggacatattcttgtgtatttcttttttcattttataacatttttggagcttttatatctaattaaattaatacttttaattaatttcaatggatatttgcaatttcctatatatcgtatattaatgaaatttaaatcagtgcatttagatcggtttgtctctttcaacttatttattgaattagtttaatttatatgcactaaaatgtgtgtttgtgtttggcttaggaaataaaagtgaaagaaaagaaaagagtgaaaattgagatgtctttgcaaatttttcttctcttgtttgattttttagaaaaaaatgaaatacaaaatatgaatataaaaatgacgtaaatatatctactaaaaaattatacatacaataacagtaattgaatctttatttataattacataaaactatccaaaaattagacacgtgtcaccattttgtgccaatttttacattttttttttctatttatctctttgcaaattgcaatttttttattaattagttttccattgaccttgcaaagcacaggtccagtgttgtagttatttaagcaagaattccttcccctttctcttcaaattcggaggcattattgaagtgtgtaggtactaggttctttccttctattttgaagatgaaaaagaatatagaaaaaaaaggggtatttaagtctgtttaaataaactttcctttccctttcttttcacatttggaagaattattagtgcgtgtgagctcatgctttttattccttctttctctttttttaagtgctccaaacaaagaaaataataaaaaaattggtgtttctctttcatccttcccatttttttcctaaactaactgtaggaggactttggtaggggaatattttttgattttatgagaattataggttgaaaaacttagttttccatgtttgatatattttttaaaaataatatttctttaaaaggatatttgtaaatcaattttccatataaaaaaaatcaatgaaaaaggtgaaaatcttaattttcacaagtaatttgtcttttaatacattaaaaatatcatcttactctttatcaaattatttaatttagtgaaaatattgtataactctttgatttttaaaaaacttatttaagattccaataatcaatcaaacaaattttattcatttccaaaaaatataattcctaagattcataatcttcagaaatcataattcttgcacataaaaaaattgctcttgtattaaacgtggtttaagaattgaaaaatgtcaaccaaaattttggtataattgctataaccttattttgaatcagctaacaatgtaaaaatggacatcaatcaaataacaatgtaaaaattatttacactgtctgttcatcaattaattattcttatcgaatcagcttggttatagagttgccataagcccataaccttatagtgtccgcagtcaaaacaagcaacatttttatactctacattgggttgttcacggagaggcattctagtaagcttttctgtttgggtcggtctttgccagcaaatgtttttccttatgggattggggtcatgccgtgtgtgtttgtttaagttttgtgatcataccaatgctcacatcacagtccatataggcttaggctggttgaatctttgtggtaggacctttagaattgcaaacaatcaaatatatggtatcataattgatgccacaaatgagatgttacaacaagtttacaacttctgctaaaagttcatccaccttttacttgatatacgactctctgtaaagttgtgacaggagtaacaatttgtcccacagcttacaaatagaattgttttattgacgaacgagtcatatttaacgcgatgaaggatattaaaatgttagaaaatttttgtaaacatataaattataataggagtagtgataaaaaactacatattgttaaccataacatatcactcggcttaaagtcaaacactaatttttcaaagtaataatatttatttaagagattcatttcttccatagatatattttcatacacattttatgccgattttcataatttgaaaatagaaattgatgtttacaaatcattatttgatctgtatgaaaacattttttaaaacattaaattattctttattaaaatattctcatttcattaattaataatctcttattttatgtattaaagatgataagagatgagggtaaagtttaaataactataattttttcttttgctaaatcaaatatttttttaaaataaaaaatattttaaagccaaagaaaaattgcataaaaatataaaattattttttaatttttttattaaacagttataaaagatatattttaaaatttattaatttaaataaaaaaaatggaagagtagaagatagatgtgatcagtaaattatattctaaaataatcatggtttcctcatacttttacttactttttttaggtctcctgttttggcattacttttgtcctatgttttaccactttcttttctatggagggctttgttttacatattcattgcgtattttcgagaataccaagttgggaaaacgacttttttttttttggaaaaacatgagttctgttacacttgccaaaagaagcaaataaataatagttagagttagccaactaatttctatacaaacacaaatttgctaatacaagtgtaacaaatgaaccatcttaagcacatgaaatttaattttctcaataacatcaacaatatttaaagtttgaccataaaaaagaatacagtttcttgtcatccaaatacaacaaactgggaatgccagagccaagcacctcatcttcccaaagtgatcggaagtagcatgctgatggattaagctattcaaagtgcctgcaatgaaatatttcttctaggaaatctgatccaatcccgaactgctgaccaaatgcacaaagaaaatctgcactgaaaaaataaacgatcatgcgtttccacatcagaattacaaaatgaacataagctttctttttcaaggaacggtgccttgtccaaattacaattttagcttataactataactagttggctagctttgcattaccctacaatgcacgggttggcttggttactaccaaattatatttacaagaaattaagatactctgcaactacttttcaaactacaagcatcttgcgatcacaccatagtttttaagataccccaaagggatatgcacactgccagattgaaataatatattttttcgatcatacccttcttctcttgcacagttgcactcatgccgttcacctccaccatgatcactgtttcccttttccaatctcaacaacttccaatctccgctcacatcttcgtcgatgctctcgacaccttcaaacctcaactttctctctctctctctctctctctctctccctctcccgcactacaactcgcgagatcaattcgccgtggttgtgcggtggtggttggttcaggattcaactagaatgggtttttgttatgtgtggtttaatttgggttttggggagaattgtttcctcatcgttggggttgtaggcaagtttaaaaaaaaaaaaaaaaaagatgcgttttttgggatgaatttgtaggtggaggagttgcggctgccgctgaggtgggggattcgtggtggttcacggtgttgtgacggtgggttttacgacggggtaggtcggatttcagatctaaggaggacattaatcgttttcattttgttctctgttgacaccgtcgatgcggagcagtggcgactacggggtggtgtcagagagggagggatggttggatactatgaagggagagggacatatcgagaaagaaaaataaaaaaataatttctatgctgacctgcataattttagggttttgacagtcttaatttttaaccaatattattacatgttattttttcattagtttttcttttcttttcaaattagtccttattttttttttaattttcaattttttaaattaaaaatatgattaaaaataattttagtagtatgaattctaattttttttagtttcctttcaacacttttttttataaaaaatcttttggggtttaaggttttataaagagcattgaaagtaatttaaaaaatagggtttaattaaaaagatgacataattttattgattaaaaaattcacagtatcaaaatccctcaaattattaagaaaataatacttttaattttatccggtgtagggatttccaccgtagttcatcactattttaaccactgatgttaaatttaaaaattcatatccagcggatgatgtttgtttcgcaccgtgagtgtctttccaaaacttttctgtcacttgtcagcaccgtgtgtttttaaatgtgttgctagtgaaagtcattggatttaaactgaatcagatgtagttcacttgtgaactcgaggatccatatcgtatataacaatttaagatagttgtatataaagaaaatagtttaattttcattgagtacaatacctcaaattttaggagaatttcattttcgttaacaaaacaccattattccaaaaatccaaaattgagtacaaaacctcaaattttaggagtatttcattttcgtaacaaaacagcatcattccaaatatccaaagttgtttaatttggataaaagaatgtaggcttaaggcccaaatcacgaaaaagaaaaagaaaagcatatccatgatgctgtacggtactcttgttcgtgtgaaatagaagaaatcaaaatcatagatgatttggtacctccatcaactttagtattcgccatgtgaacgtggggaccatgttagtaccactcgtgattatccacagcatgaaacttttgccagatgaaaatcgctttcacaaaatattgacatccaaaacaaaaagaaacacaagaaaataagatcaagacagaaaaaagttcatgtagcagttaagataggaccaagcctgtgagaatacaaagttaagattccctgttacctataacagatcaacaagtacagaagcgagaatcccactggacagtgcattatttcatttcactactgacatcagttttcattctaaatcctatgtcacctgaaagtattcccttgatccaaaggtaaccaaaagttcagaagaaagccctgctgccataaaacacacgggagttagtgctctttggtgtctgtatcttctgttcagagctagagtttcctgaactagttggtccactttcaaagtccataggaagcttcattttcgccagtgactcggtgaattgctgcatgcttttcatgtacatgtctacaaaatcctgctgcaccacattaggctccggctcgatgttaacagtcacaacaggcttagtgaatgactcattcagcaccccatttgaggagtcactcccaccatctttgacatccccatttttctcttcggtggctgaaatttgttcctgactgggagacttggaagcagcaacatcagatgagtctgagcttgcagccactgaaggagatgaaaccccatttgttaacacactgctgcgtggagaatcagccttaggaggttggacagattcaacactgcatgctgagaagctctccacaatctgaacacctgcttcagaactaagattttcagtatcagtagtggtcaagctatcagaacactggctctcctcacatggaatgccaaagtattccgaaaccatccagtggtcttcatttacaatttttggatctgggaattcaattttgtccaaatctctggccagtgactcacatgattctgagtccttctcggtgccatttgcggccaactcagtaggcattgcagaaatagccataacatcaggtgaagcaccgatataagcaagagacaatttaacaaaaccagctggggaatgaaataaatcagttgaagaaagagagaactctttctcaagttttccatccttcaccagtacttcagacaaaggcaccaaagcaaaaccaagcaactgatcttcaagataattcttcaccctgctcagcatccaaatttcacatttgacagcagaatcaacagtcctaacgcttagacgaagattctcattgaagacagggttccttcctcctccattgacagtcttggtagagacagtattctcaggattactagtcaagcaaatcttagcataaacatcttgcttgtggtatatgcagatgttatgaatgtccctggcctgatgaatgtaaacatcaacaacaccgatggattcctccggattaacctcggcagcttcccttccattgacttcaatgtccttagacaaaggacccgagctttgtgtgaaaacatcagacctatacttctcagcttcacccaagacagagctcttgaatggtgacacaacagattgtggggattccatgatatcacagtgattgggaacctgacaaagcaaaaaaaccttcaacaaattcaagtcactctatgttaagctaagcttcaaaccaacatcacaaatgattttttgaacttaaacccaaacttcaaacaggaacaaggaacaggaagaactcaaaattcactattccaagaccaaaactgctaaaactcagcttgaaaatacttccttacaatttgcagcccaggaaggattaagcacatccaaaacagatagaaagtttctagtatgtgaattgtgaagtacaaaaaaatagaaaaaggaagaaaaaggaaaggcaacactcaatccccaaatgtgaaagagaagtgggaagcttcaatctgaatttctcctaagggctgtcacgtgagttgtcaactaacaggaaggaaggcaattcagaaacaacaactccagttcataccttaactttatagctaagagcagagaaacacggaattgaggatcaaggtccacaaaacccaagtagagtgaaacgaattcccaggaaccagaacctcagcttcaaaattgaaacttttcactttctagagaaatactaagatgcccagaaccggctaaaacttaaaagctatcaataagaataaagggtattgccagatttgaggagattctaataaagctactagcttttttttctgctgctctatgcagaaaaactaccagcggaatccaagggagggaaacagttaaagcaaaaatagaaacatacaagaattcagagagaaacaggaaacaaaaaaagaagagagactttgattaaaaacacagagatgattaagttgttgtggtttaacatacctgccttaggcccttagcctccaaagtcaaagcggaatgtgttatgtttgtggctctaatccagaatgaaggacacacaccgtgttggtgatgagaagagaaggaacaaaagcaaggtggcttgtttaaaaaagggaagggataatgtgaaaggaaaggaggaaatagtgtgaacagtgaagaaaataaaaatctagaggtgctgtagtgttgtgtgttggtctatgattttgttgtgtgtatttggagtatgtatgttgagagtatatatgagcaattaataaggtgctgtgcatacacagagggcactcatttattgcaattgttgtgtgtggggatagagagagagagagaggataaggtatggaaatggaaggggatgcagcagccccgcgcgaatggctgagacagaccaataagaagggagttgtgtgcattttgcagttggaggtggggtatgctgcttatgacttttctttgtactttttctgctccacacttctctttctgcccccacctacgactttgagtgagtgcatttctgtccttctagtgttttttattgtttttttttaaacaaattaaagtttaatggtgatgttggtaatgtataaataatataaaattattttatattattatttaattcttaaaaaattgttatcaaattataaattatcatttgtataatttttaagataatttaataaaatttaataaatttatcataaattataaattgtaatttaatgataattttacattgttacttattagtgtataatcttttttttcttaaaattatacatatatattttataaacagataattttgtttgaactatgtagtatttaagataattcttttttttttttacaaaactaatgaatataacttagttgataatatacattaagtttatgagagaaaatatgagaaagaacaaagaattttaaatatgattataagtttggattcgaggattaattctataatttgtccaaaaggtcaagcttgtagttgtgggatatcttagagtctcaagaaacaaaaactctaattagagagtacttaaaatatttatgtatcttgatgtatatgtccatgatatttcttttttgttgctttcacatgattatgaagaataatttataagataatagtttaattttcatcctttacaaaaaaaattcatgttataatttcggttatatccagtccttataaaaatgagttagtattaattttagctattataaaaaaattatttaatttgtgtccctttaaaatatgaaattagtgtttttcatctttataaaaacagtaaattttgattttggtttttgtttccttcatatatccttcctaaatgtgaaatcattgtttttttcttcataaatatcatttttagaggtaattttgtttgagacactaacaaacaataaaaaaaataatctctttaagtataaattcgaaccttgatttgtcagtttgtgaggatgagtctcttccgctgcactcaatcctcgttggtaagaaactattgttttaagttcttaatgtttattttaaaaaataacattatttgaagaattaaaaataatttagaaatgttacatgctgacatagtatcacagactagtaggtgtcacttggatattcacttaacctttttattttaaaataaataagtaaataatattattctaggtatctaaaaataattttagaagtgtcacatgttgacaaggtataccacacagtaggactcacttgaaagagttactttttatgaaacatatgagtagttgagaagtgaatcttactgtatagttgacaagtagttgaaagtttcacatgttctcgatcggagcactcaggacctgagtttgccagggagatttcctactcttcatctcagtaagatttgaatttgatggctatatagatgaagacccttataatagaatttaccttgatgaacatgaacaatcaatcagtctcattatattgttgctcagccagtaggttcatgttattctgaaataccttaattacgtatactcgagtcttgggtttatagagttacaactacatatcaagaaataatcaattaaccctctttcttttcatgtataatcccataaagcaatttaacattgttggtgtttctctttctgtgtcatttttttatgtgaagaaaaatatgaagtcaaatttgatcatcaaaaatcctgtgcaggaatcctgtgcaggaaatgcattgatgttatgtgagtctagaacatgagagatttcctcgcatgataccatcggtcgcccacttatgagaagagcttttgcacttttgttctagaaatttgccctttttcttcattcgtgggtcccatggcatatgcttccccgacgtattttgcaactcttgcaccaaagttttacgtaaaaatcaaagattaatcatggtggggtcttctgctttgttcatcagctcaaaatgacttcttagaggtatcaacttaaaagaaaagaaaaatgacttggaggtagacaacaggggcgtcactagttcactattcaacaaccctcaattgtgtctttggaagagaagttaaatggcgtgaatacgtttttgtaaaacaatttcagagaaattatgttttgtcagtttgttacttatttcgtatttacttgttgaactttctttctcctacaataatttatcttgagcactatctatgaatatataaagcattcttaatagcatatatatatagcaactgaaaccatgatgtgttgataaggaatctgggtgttacgggtctcaaagtcccacattattgagtaatatggaatgttgggtgaagtatttaactgttagttctgttttttttttatatcaataaatatgttctttttatataaattaaggtatattaaagttggttatgttctctatggtgtggttgccaaaatgtcattaatttgatttttctatttataataaaataataatatttgaacatctcattattttgaccacactatctttatctcttattcttctctttttttccatcatactatcacttgtcctaacttgtaatggatataatattatttatcatacttatataagtgtaataaattatattatcttcatttttatttaaaagagagagaaaaaaccatgactccaaacatatattttatcaactaatttttaaaagaggatttcccaaatagtcagatcatcctctcttaaaagttagatgcttgtgatgttgatcttcttctaaagttgggtaatgtaatatagtataattttattggtgtaagaaattaccaattttttgtcaaactatcatagttaattatatctttcggaggactatatcgtctattattgtagaatatctcttgaaatttatcaaatatttcatccattataaatttttcagttctaaaataagatgtgacccaccactattaactactcgtgcccttcaccgattgaatattttcccttaatttcctaaatgtgacgcgtgtcgtgaaagaatcccaacccaagtcccctatcattattattattatttctatatattgttttttattaatagaaattaaagatattaccaaaatttacaacaactcatacatatttatttaactaagtgagtgagatccgtgacaatctgcatgctctttcttccccttttactttctcttttggatcggtaagaaaggatgtgcattggagtgctttcatgtgcctttctacttttgctcatcaaatacccttttttcatccttcacatatatagtcggtatatggatgccgtaatttgcgtacaaagctttcagatattagacaccgtaatgaaaattattgaccaataaagctagtataaatactaaattaatataatagattttaatatcttctttgaattttttggatttgaaggacatgtgggtaccatgtgagacttttgattgttgcaattcgctgttgcattgcatataagaacaaatggcatagtcaattattaacagtgagttgtaccatttcaagaaaaatgatataagcttctggaaagctaattacgtaattattaaactacgattactattgactcgtgatagaattgaaatgtatgtatggaggacgagcctctgatttccttcttttcttttttctttttcggtattttgagatgacaaaagatttgtatcaatgaattctaattcaattaattgaacatgacatataaattattataaaacttttgatatttatttttgattctcacatataaaaataaaaaatttgaggtgatgaaaaatttgaaggagattatcccattcaggatatatttggataaatattagaaactagttttatggattctaatgcataaaattaagaagaaaaaatattactgttttttgagtaaaaaaacttttttctcttaactaaaatttaaaaatgcacttaatggcagaagatatgctattaatttcggcgctaaccacatgattcttatcataaggaaattgttgacagtggaaactaaactcgagctttttaatttcaataattccaaactaatcatgttggcttgtgagttgaaaaaatagttatgccttgtacatttagttacataattttgcgtaattgcccaggtggattgatgctattgtgccaaataaaaggtaaaccctgaaaaagtgttggcaaatctcgacactgttatcgaaaaattgaaatcatatgtgttcatttcccattatcgttttcaatcaaactactcccatatcttttatatggataaaagataaatggatatccaaaactattagacacctaagtgtgagagaaaaatataaaaaaaaatgattccgtgattaaatatataacagtaggaaaataatactttgagaactaatatgatagtagacacatagtgagagtgataaaaaatgagaaaatataaatattataaataatataatatgataagaaaagagacagagaaaaataataaatattaaataaatgttttaaaaagaaaaatatcattgttcataatgataaaactttcagttatgtgagctagctcataatcttagtaaaaaaaaattactagttttaatttcaagttggactaactttttcctcccagcccaaaacaccacagaaaaaaacgtttaatttaaagtttttgtctaaacttatctatggttttcctctattaaagtctaagtagagttgtgtgtgtgaaaatagagggagcacaagagtaatgcatgctgttgttataattaagtttaaagttgagtgtgtggataaagctagaaagcttaaggggctaagctggctttacatgcttgaatatcatgctggtctcaatgtggcaactggagcaatagtcatcacaaaatcattcacctaaagttaagtgcgtcaagagggatcacatgtacagtctgaattgtaagctcatgttatctgcaaatgccttaattatgtgagtgtggaagagaccaaaattaattaaatataatactcgtgtgttgctcaaatttatgttaatataaagattataatttaaaatattaaatatgtatttttttagtataggatactagattgtggacaaagtttgtagtataacattatatttttattaaatttaaaatattaacaaatactatacattaaattgataattatattacttaattgatattttaatttattataataaagatttttaaaagttattacaattcagaatttaaaatacatatttaattagaataaatattgattatatattcctaccaatttttatggataatttttctttggaatgtgaataaaactgaaaaatagaagagagaaaaaaatcacatgtagaataaatataatgacaattttttatttgattgaattaattttaaattattaaagtgatagttaatgtaatttattataataaatttggattgtaaaaagatatataataaatttagaaattaaatatattcaatacatcaatattatcaatcaaacactaatttattaacatcaatatattgaataattaatttattagcataaatatgttatattaatgttagttaattacatttaattattaattatatttattagaattaaaaataaaataattttattgaatattttttaagaaaataaatataagtttgtcacattatgacatacagcaaaatcttctttttatggtagatttaatattgacctatttagatacttacaccctttacatgaataggttagagtaataattttcctgacatatctggccctttctcatctcgtcctaataaatattaatattacggaattcttctttcaattgcagccaaattgtataattgagatgttttacccttataatatccagagagaaaaaagaagaagaaaaacataggaatataaaaatcatagtcacaacaaaagctcaatttaaattaaatgttttttttttctttgtttgaagccattatttgtctttaggaaagaagaaaggataatttggtcatttcattggctattatccttcttccaacggtcatctaaacctcctcaattcaaaaacttgcttctcttctctgtcttcactctatcgacgtttgaatccaaaactctcattctttctgtgtttatcactctctctctctctctctctctctctctctctctctctctctctctctctgtgtatagcttcattgctaaattgtttgcttgctcagcgaaaccataaccatgagacaaagcagtaacttagaaactgcagagactcgtttctctggcaccatttcatcctcatccctcaaaaaatttcttcccagatcactctcttccaaacacaaaaccatttcaaaccctaaaatcccaaattcagatgcagagaacactccccccaccgatcccaacatccagatcaaccatgaacaatcgttgccttccacaaccaaacaatcacagtccaaaacctcaatttctcagaacaacctcaaaaaatcgaaattccctcttgaatccgacccatcagtcaaggtaatcgccaatttttctctctttttgggcttatttttttgaacattgaagttgttatctgtgagtctgaagatgggtatgacgtatgtgaaaaaatttctgctgcttatttgcttatactatggttctgaaacaggttgtagtacggatcagacctacgaataacaatggaatagagggagatcgaactgttaagaaggtttcttctgacacattgtgtgttggggataggcaatttacctttgattcagtttttgattcgaacaccaatcaggtaaataacttcacttcattgtgctatttgtgatttatgttctttatctttcaataattttccatgataggattaaggtaatttacttactatttatatgacttgcttttataaatgaaacaactagtatttttttaactttaaataattttctctgataggattatgatacttactatttatatgacttgctcacttgctttggtgaatgaagcaactaatagttcattttatttgcttccatgctgttaagagaagataagtgtgatttatataagctgttgtttgttcaggaagatatttttcagtcagttggtgtccctttggttaagaatgctttagctggttacaacacttcaattctgtcatatggccaggtacttcttgatgtttgctatattattttaaccttttagtgagagaaaaaaatggcattcttgttcgacaattaattgttggggattttttttatttttcttttaattctttgctagtctggaagtggaaaaacttatacaatgtggggtcccccaagtgccatgtttgaggagccctcgcccaaaagtcacaagggaattgttcctcggatcttccaaatgttgttttctgagctggagagagtacgttttacttcctgctttaaccactaaatctattttctattatgtttttgattattttttatttttatttttcaattactatattaggagcagcatgtgtctgacgggaaacaattcaactaccaatgtcgatgttctttccttgaggtaattctttataaaacttcccattttggcttccttgtttgtatgatgatgatcttgtttctttttcatttgttgtttgaaacagatatacaacgaacaaattggggatttacttgatccaacccagcggaaccttgaggcacgcatatgccatccttttgtgctacaatttatcataaaagactaatacactagttttcgattgctgcatgcttattatggctggtctaaattattgcagatgaaagatgattccaaaaatgcattgtatatagagaatctgaccgaggaatatgtcactagctatgatgatgtaacacaaattctgattaaggtagggactacggaagcatcaaaggaaatataatatattgttgaatattatatgtctacatactatttatactttatcagcttagctaatttggtctttatatgctgcagggcctttcaagcagaaaagttggaacaacaagcttaaattctaagagctctagatcacatataattttcacttttgtgattgaatcttggtgtaaggtattgcccactataattgtatttaaagtgactagctatggaagactaacatcttttttttcttttttcttttttttttcttatttaagattgacacagatttatattgttaattttctcttagttaatcgctacttctggttttttttgactggtgctgcagggaatatcatcaaatggtttcagtagttcaaaatctagcagaattagcctcattgatcttgctggacaggacagaaacaaagttgaggatgcaggcaagcaatgtctaagggaagacaagaatgtaaagaagtccttatctcagcttgggtaagatgccatgtcatgactagatacaaatgtctaaagttggtagtttttcagttatccaaatatttattaaaattgtcctggcaacacatacgtggcttctcttgatttccattcctgcctcatgccatttactattttttatttgttatttgtgattttaaccgtttattgcatttttttgtctcttccgagcaaaatgcacaggaccgcatctagtgttggttgaaagcaatatcttggtcttatttatttatttaatgggtgaagttatcccgtccttattttacttctttgtaaccactattttatttcactgctgtaggcacttggtagaagccctgactaaagaaactcactcagaaaaagcagaagaaatttcaaacaggaattcctgtttaactcgtttactacaagaatcactcggtggaaatgccaaactctcattaatctgttccatctcccctgataacaagtatttacctggaccgaggagcattacctattcatgtgtatgccagacatcttatattttgtttctagtggtaaagattgtatttgttgattgtaggaataatggtgaaacgctgcgcactctcaggtttggacagcgagtaagaaccattagaaatgaacctgttatcaatgaaataaaggaggaggatgttaatgatttaagtgatcaaatccggaaactgaaggtattatttatcttcaggacttcactgacatagtttttaatgggttgatacagatctgacatcacagaattatgtgtttgctttggcgcaggaagaacttattagagcaaaggctgaagttcatagctcagatgggagtaaaaatggaaacctccaagtacgcaatgtacgggacagccttaatcagttgcgagtcagcttaaaccgctctctactcctaccctgcattgataatgacactgatgaagaggtaaatgtggacgaggaagacataaggaaattacgccagcagattgatgaattgtatcattcgtgtgaagagaaccctaaaaacatatctgtcagtgaagattgtgtccagtattattctgttgcggaaaattgtgacacagatatgaccagtggtgatgaaattgaaaaagaggaagtatgttatggagaagcaatgagtaagctatgtcccgaggaaactgagggatcaactaccaccttggatgcatcagcagatgactttgcatgcacagctaatgcctcaaggacaattaaatctacattcagagatagcatttcagttagctcatgtagtcggtctccaatacttggagaaccacagttgtctgagtctccaaaaatcaagaatgtccagaggaaaagtgtggcttattcaccaagttgtcttggaagttggaacaatgtggcagaggagaatatgagttccagtaatgatatattaaggcaatcatttaaagagggtgagcagatgcgatcgtcactacgttccagcaaggtttttcaaggtcctaccgactccttggcagcaagcctacagaggggattgcagataattgattatcaccagcgaaactcagcattaaacaaatcttcaacttccttctcttttgagtgcttaaccttgacaccttgtccagaagacaaggatgattcttgtgatcaaataatgcaacagaagaaatattctgtcgatgaaagaactgctagcttgctttgcgaatcttgccttaaaagaatatacgatcaggattctactgaggttcaagatagcataaagtcaagagttgaaacagctgaagcagagaatccggatggactgacagataaggttccaaaagtatgtcttatagacgatttccagaaagttctgtgattaattttcttgtaaaactgatttatctttgttttttatgcttaaaggatttacagagtataatggataaagcaatctcgagagaaaaggaactagagaaagtttgcaagaagcaagctgctagaattgaagaactaaatcaattggtataaggagtcatgccctcgtgaattatctgtggtgtgaattttacattactgacaatttagtttggtttgtccaggtggagaaattgaaaggagaaatggaagtaaaatcttccatcattgtgtatgatccagaaagcaataaactgactagggatgaagaagagtataactcattgaaagatgaagacaaggtcaactgttggttttgtaatttaacaatataaagtcctatccattggaatgtttggaactcgcccttttaacgtaccttttatgttgtttgcagcttccaaggggaacttccttagacaggcatttaccaggtattatagaggaaaattgtgaaattaaagaagtccaggaagacgtaaatcaaagagacagctctttcgatgcagctgagaaggaagaacttcttaaggagattcagaatctaagaagcaggatgcaattatgtagtgatgcaccagttaaaaagtccaccgacaaactaagatcatccttatcattaatgtcaagatccattcaactccgaaaaagtggtgtatttgctcttgataatggtggagatgagctagagaaagagagggagagatggacagaaatggaaagtgagtggatttgtcttacggatgaactaagagttgatcttgagtccattcgtcagagggcagagagggtagagatggaactgagtttagagaagaagtgcactgaagagttagacgatgcactaaaaagagcggttctcggacatggtagaatggtggaacactatgccgacctccaagaaaaatataatgatttggctgcaaagcacaatgctataatggaaggcatagcagaggtgaagaaagcagcggcaaaggctggaaaaaggggacatgctcgctttgccaaatctcttgctgctgagctttctgcattgagggtggagagagaaagggaagcaaaattcttgaaaaaggagaacatgaatctcaagattcaacttagagaaactgcagaagctgttcatgctgctggagaactacttgtcagactaagagaagctgagcatgcagcgtctgttgcagaggtaaaaatcccatcaattttttcaaatgcatttgataaatgaactaacttggtgggggtgcattactttatgcttaacgcaaccctccctaaaatcaatagatattagataggacttgtggaaaacgattttgtgatgatccatttcggacaattctaattttctcttgattttcatatttcttatacaggagaatttcagaaaagtgcaacaagatgatgaaaagctaaaaaagcaaatggataagctgaaaagaaaacacaagatggagattgttaccatgaaacagtaccttgcagagagcaaattaccagagtctgcactgcagccactatatagagaggattctgatgatgttcacaaggatgcaacttcccatgatgatcaggcatggagagtagagtttggagcaatctatcaacagcattattaattcgacattagttggattgattaacaattgatgagtttaacaatcaaacttccaaaagtttgtctagcatcagaagatccttcttggatcaatacaccccatttatattctctgtgttgttttaaaattcattctattttttaagctgtgtgtgttgttttaaaattcattctattttttaagctgtgggagcacttggtttttggagttcgaattcttttctgtttgtactgacagtaggtaaaagtaataacatcgaattatttgttctttaccgcttgagttttgctggcaaatacagaagctacagatttttttatgaattatttgaggaaatattgtttagaacggatagtcggatacaaacacaactcacacaaatctgtacccaaaaaccaaggcaactcacaaatatggtgtactttaaaatattgtgaaggctatattaagttaaggatataaaaaaaatactgtattaattgtttttgttatattgagaatgagtatattttaggcaagggaatgaagttttttcatgataattagttttatattttaaataattaattgctaaagataaaatgggaaaataaaagtttttggaaaaataattcaatagctttcagtcgtaagtaaaatttttatttataataaaaacttttgaaacacgggagaaaaaaagtttttcatattaatctcgtttaaatacactttatttataaataaaaataatctcaaaagcaggaaaaacttcttaatattatatatttaaaaattattcatgtcttctttctgttattaatgaagagacttattcgatataaattattcatttaatatctaaatatttttaaataattagttgatgacagttattatgtcaagctttcaattccagacataggatttcacaaatatcctttcaaacaatttgaattggtattttcagtacatttaaaaatagaaaaaaagaagaagctctaagcgataatatgttgtgctctctcgatctcaaaataataattgttctaggttatgtttatataaattaaaataataataaataaataaaaataataaaaatatataaaattaatcttatcatcattaatttattttatatattttgttgttcgtcattaattataaagaataaaataaaaaactaatatatatatattaaaataaaataataattatttttaaataatttttttctgatgataagtataatataacggagggagcatttgattaaaataacttaatttttaaatatttttatctcaaaatgtacgttatggttaaaacttaaaaagagtgaaaaaggtggaagggaatagaacagcgtcgtggaggatgttgcaaagggataacatcactcactcactcgcacacaatagaatcaaaaagagaaaacccaaagaggcagaagacacagaagagaggttcaacgtcttcatcatctatggcgacgccgaattctgacgcaacctctcagactcaagattccgacactgttcccgattccaattctcccaacgccctcgtccccgccgctcccgccgtttgcctcctccgctttgccacagactccgccggcggcgctctcatgggctccatctttggatacggttcttctcttctcttctctcctctccgtattatcgcattacgccgtcgtttcatagactaattaccgtttaagcctaatttcttcgttcaactatttagtcgaagatttactgtttctgtcgatagtatgttaagaattcagtgcttgaattcttcttcgaagatttactgattttgcttgaggatgcatgttatggtgtgtttcaggtgctggattgtttaagaagaaaggttttaaaggatcctttgtagaagcagggtcttatgcaaaggtacattgagaatctcgctgcctttttttcctgcttgttttacattggatacttggttcatatgtaattttttttgtgcttcaattgagcttgcaattaattatgttgttctttttgtcattagacatttgcagttttgtctggagttcatagtttggttgtttgcatcttgaaaagacttagaggaaaagatgatggtatgaatatttaattataaaatgtgtcacttttgctttttagtgaagctctggtaatgtgaattcttttgcatctacagtcattaatgcgggtgtagctggatgttgcactggtcttgctctaagttttccaggtatcttttatttatttatttaaataaattgataagtttgtcctttctttgaaccttgtaagaaaaaattaggataaaggacttgtcaatctgactattctgaatatgcaaagaaaaaattaggataaaggactttttaagaaaaaaaaactacttaccccatcgtccagatgctccttactatatagaaggtaaggaagagggatattgtacgcaatcttattcttgcatatgcaaagaggttgtttccagattcgaactcatgatcaacaagtcaccaagacacaacttgactgttatgtcagggcttgtcctcccccaaaccatcacctaatatggagaggaggggggaaatttgctgatgcagaatgccttccaataattgctattgttaaaattcaattcattgtttagctaaatacacgtgtaaatttcattttgtatactttttgttatcaggacttatattctaggattttacaggtgcaccacaagctcttatgcagagctgtctcacttttggggcattttcttttatcatagaaggactaaacaagcagcaaccagcacttgctgttcccacatcctggaaaaaacctgtgcaacacaatgcacgttcgcctttggtactgccccttcaactctctcttccagatgaactaaaagatgcgttctcctttttctccgattctttgaagaagcgcagcaagggaccttatcctacatctcgataagagattggggtatcgtgattttctagcatcatgtagataagatgtgcactctttgccttttatttttgtaggtttcttgtagcggttatcaacatttcttttttgatgaacttaagggtgacaacaaattgtcgaaggacatgattatttacatgttcgtggtttgttgaacttggattatgatgactgatttaggttgacccgtgcacttactaatataataactgttagtattaggtgacagcgatatttgtttgaaagttaaactctgcaattttggaatttttctggttatacatgttacatttacaaatttatgatttttaattagaaaattatgtttctgatcttggttggaaatatacttcaaaagcatataagcacctagtccttacttgaatatccatttattctaacaacagcacatatcttatcaaacttggtacaaatgcaacttgattacgtgattgaaatgtagataactgaaatctaattaatagtgtcaactacatactacatatactcaagttgttagcctttcaaatgaccaccacaaaaataaacaaagctaagttattttaatagtgatgtttgttatcaatgacaatttcacgttcaggtaagtatctgtggtccatagaagacggaatctgtcgcggcggcatatgtttgcggtggcatccccacccatagacggaagctctttagttgattcctttgtaaaatctaatttgtcacttagctgcaaataaataaccactcaaattgattcctttgtaaaatctaatttgtcacttagctgcaattaaataaccactcaagttgattcctttataaaatctaactttgtcactaaatacttataaaaaatttctattaacttattttatgttggtcttcaattctcttttattccatctcttaatataagaattatgtatccgagctattatctaattttaacattgctatgtggtaaatttaagtttgttttcacttaaaaaaaattgggtttgtttagaaaaagatttttatatacatttataggaaaataaaataagaaagaaaaaaaaaaactttttctaaactaatttgtaaaagttttcatattagttttttcaatttttttaactttcctctttttagtgttaaggtgtgtttgtattcattttaaaccaggttgaatgtgaatccaatatgagaggaggattcaatgtgtttcaagaagtttttttttttttttttctttctaaataacaatcctatttaagttaaacagttgacaaaaactttcatttaaagtaatatgcattaaaacaaacacattattagataaatacatgttcctacatgaataatttataatcgaaaatttaaaactctacattaatgttccctcttcataattggtcatagttattttataaatactactttacttttaaaacattatgtgacattagtcgttcttatttaactaagctacaaggtgtcgaatttaagtaaattcactcttaaattattttataattaatataaaaacttacaaattattttatttattattaatgattaaaacttcatagtttaacatattataaatacatgataaaatatttacaatgaataatattttaatagataatacaatataatcaataacacaaacaagtgagtgcatagattatttgatacttatctctaggttgacattaaatatatggtaaagaaaattatgtaatccttgataattttatttacgtcaatccgaataaaacatggcgtttatgtttggattggtgaggagtaccatcgcatgcagttgacaatcaaagagcattttcttcagaagagcagaaatcaacttattttttctgcaatgaagtctgatgttagctattagagagggttaagcttctttcgtagaaatgtatatcaagcaaatatggttgctgcagttcacgcatatcttttggttgctgtatgcataatattatcatgcaggggttgggagatattgattcattttttttatcatgatatcactggtttgtttcatgggtagggatgtttgtttgtttgtaaacttttggccaagttgtccacatcttgtgaggctgggagttataattagtcagtttacttttgcagtttttaccaaattatcaagtttattttgtaaggagacaaacgaattttacagcttattacctagttagggcagcaaattcgtatgttgatttaccaatggttgttgctgaatagatccatttggaaataatataaatatcttttcataaaataaataaattaaatgtaatatcgttttcacttcctaaaactgagcatagtaatcaacaacttgagcctcatttttttttcctaataatgcaactttatttatttaacattaaattacatgaacatatatcaaatttaaataattaaaatgtccgtaagttttaatcgtgatagtatatggatagagaaaatataaattataataccaggggtacttatcaaattaattccacaagcttgttctgtattagtcacttaatggatcaattatatagaaaaaagatttttttttcgttaacaatcacctcaaatcattattaataaaagggtaatatagttgtaaaacttttttatacctaaaataaaaggtactttatgtcatactcggcaggtaatttgtaatttcatggaaagtcatgtaaatgaggttgatggtttgttcactttgttctatccataagattagaaaaacttttattcaacttttttttttttatgtcaattcacctatttttatttttcaaatggacccttgtcttttctaaacatgttttttgatatatgtcttttctaaacattaatatatataataatggaaatagtaatatgtatttttataaactctatgatttagtaaaatcttacgcttacttaattaaataagagtgagacatgaaattttatcgtgaaagttttaaaaaatgttaattatcaaagaatatgttggtattattcctttcctagcgctactctttcgatttactaaaatggaaatgaatggttagataaggtataagaataaaaaggtttttattaacacctgtggatttaaatggcaagaaatttggtttatcttgagtaacgtgtcaggtttttttaaaggattataacgagaagtttaaaaacaataaaaaaaaaaaagaagtaaaaataacaagtttaactaactagaattttaactctgcttttaacttactacatctggattttaatttacgcatacatataatattgacataaatataaaggtaaaagggatagaaactcttcgcctaattcatacattccaatatacatcagaacttattttgcttcccatctttcccaaatcaaccaacaaatgtgacattaaataaaatcaataatcaaggctaattgcactttcagacctccaatgtctagctttctcaaatccgttggtatagttctcaaaatcatcaattgtttggtcaatctcttcctgagtattcatcacaaaaggtccaaattgcaccacaggttcacccaatggttcacctccaaccaaaatgaacctaaggaccttagaagatttgttccatgcctctaggccatccccaggaccaagaagaagtatatggtgagaggttacaagttgagacttttggtttccaaatacaccctctccttccaatatgtacacaaaagcattccaagactttggtataagttgttgcaagtgagcaccaggtttaagagtaaaatccaagtacatggttggtgtccttgtgtagattggagactttattccaagagcttcccctgctataactctaactttgataccatctatcatagtttcagctatgtccttgctcaacatttcttggtaccttggctcaatcctataagataatagtacaaagacatattaaaccaaagttttagagtctaaatgaagaaactactttaccaatttaacgtaaacttcaaggtagacaataaatgcttcttaaaggataacaaataatacttccaagaagacactaatggaaaagttgaattcatttttagtggggcatccataaccagacaaattttgaactagcattggcaacatgttattattgctcttattattgaagcttccaccatcactataggatatatggggtgagaggcacattctttatgctggccatttaagtcccttttgcacacttgcatcttttgatgccctatttaagagcacttctaggaaatggtacatgatggcgaatcatgaggaaaaagtcacatgtgaaagtaaggaaggcatatcttaattcagaaagttttaaaagatttgactgtttctttgtaaagagtgaagttcctttcggtctcgttgatatttggtgatgaggattatccaaaattatcccccaaaccaatgatgatgatgatcttcaatgacgcagaaagtacgtcatctaatatggctaagattgcgatttgagtatttcataaaaaaataactcttggtcactcttatttggagctttttacattaaaaaattaaattctaggtataaatgaattacaggatatctataaaaaaattatttaatctatatttagttttgtgtccactccaaaagtgcgtcatcctgaagcaaaaaatagtaacttttgtgtttttttcattcatttgaaatgattttgttgataaacatatatatatatatatatatatatatatatatatatatatttgatgcttatccaaatacacttacaaaaaagacttatgaccttttgtaagttcaacaagtacttaattaagttgtttaatatttatgaatttttgtaagggcaataagtatttaattaagttgtttgttgataagtgtctctaacattggtacagaagaattgtccacttacattttatgttttgaagcaagattgatccacagctgaagacccttttgggttccttgagctgcaggcatttctgagtgaactatccctctccctgcagtcatccattgcaagtcaccagcttcaattgttcccttatgtccttcaaaatcttcatgcgttacagctccctaaattgcgcaaaaaagttgcattcaggtgaggctagcacatcagcacaagcatatgtgaccaatatatcacgtacacaactttagatacattacattacactcaagtggtagttggcattctagaaaagcaaacaagatatcaacatgtggggtcactcttgtgtttgtgcttataaccaactactatttgcaatcaggacacaatcttaaatggtatggttttagtggtcctaatcttaattggtaacgaatcatcaatttgtgacttacatgttgccacaccaccagcacaaagattaacaccatattgagctgatacttagctcaattaaaactatgagctaatatagaataaagaaatcataaagcgaaatagtatttagtttacttttaatttttcgtttttcaattttgttgatttgcataatggccattatattatatgcctttgactttataacacggattggaacaaaaaatgaaataactcaaaacgtggtttctctaatgttggaaaacagttttatattataatcaatgatcaaaggaggaaaagcccatgaactaaaacaataaatatttgctctacctgcaacatgtatgtgaccgtctcaaatcctgttgaaaataaaaaccaccacaaggaagaaacaagtcagaaactaagcaaatcagatcattgaagaacataaatgacacagaagattcaattggcaaacctctatgtggatgatcaggaaacccagcaggagcagtcactgcaatatttcataatttcacattcttagaatacaatacaagattgaccatcatactttttcataatccaaattaaaaaaaacagaggaaaatacagagatgcccacctgagaattcatccaaggcaaggaaaggatcaaagtacttgagttcaaatctgaacatatatacccacaaaaccaatcaattcaaaaagctcaacttttaaacaacttgcaatactatacacatataaagttaatctacacctttcaaccttaggatccaaattaatcttagttaaatataatcataactatgcataatggctaaggctaagattaactgtgttatcgttgatctctctttaagtcttacctccctatgcttcttctaacaacggctccaacaccctcatgctgaggtctggccaagaactttctggctacaagacaaggttcattaatgcaactgcaaatagcttggtccggcattttatgaaagaagtgcaaaagagaaagaaagaaaaaagtttatggaatgatggaaatgtgaggagcaagacaaagattgttgaaggtatatataggaaagtggggggtgtggcgtgagaaagagaggaagaggttcactcttggaaagtcaaactcaaaacgttgaggtcatagcatagaatagaataagagtttgcttgagctgaaggttctttttctttccttgttcctatgaacgtcagcataacgcactcatgatgtgtgatgtagtgtgctatgtttcataggaataggcataggacttaggaattttttgaattcatatagtatgatatagtatcttacttgttacatgattaccacctgtcatgttgaattgtgtgattttctcttcaaatcaaatttaaggctcataaatatcatataaaggcagaagagaaagagaaaaaaaatcttgggtcctagatggatttgtgcctctgcatcatcacttgacaattgacatcacccacgtttcacaatcggttaattaaagtcttgacttgtttttaacaaccttcgcacttcatcattttgttctactttacaattttcggggaaatgggtatggcctcttttgtttgtctatttactctttcttataattttttaattaaatttaaatggttcaaaagttgagtacttttttctttttcttttttttttctttttagttttattctttgtcctatactcggtgtcaaagtattaaaaatattcttttcgaatctctttgttccattatagatgaggttaaggttaagtttgaaagaaacaaataggtaaattagttgaactacgcataaacacttaataataacaaaaagaaattatgagttaaatttaattctcaaaatgaaaattcttcattcaaaaataaaaatggaaatatcattagttgatttaataattaagcttctattaattataaataaatatgttgaactttggagcataaatttaatttaataatatttcatatcatttatactaaacaatatctggagcatttcaaatgattcgattatacttaaaatgtgatttgagaataataatttttttaacgcgaggcgtggcttttatcatataaatatattttaaaaaaactgcttaaccatatttacagaaaaaaaatataatcgtaactaatatgaaataattttaattataattttaatttctgatgtatcattgttctatatgtagtacaaaaaatgatgcaaaaagttacttgtgtggttaaaaaggttctcaaatcaaattaatccccatgtgaaaaaaaaggttgatttatgactaaaaatgcaagacgaagtaaagtgagatatgggtcaagaaatagtggtccaaagcgtgtttggtgtaggcgattacatagagaaccatctttaaggagacacaagatagtatataaaactttaattattagtatatataattatcgaaataaaaatttatataattaaatttttaattaatagttttcaaaaaataataataatagaatgatagaagataatatgacaagtgtatatgtgtatatatatatattataatatctatacgttttagaatatattatactcctattttagaatatatttttttcctctttcttctcattctctcttaaattttttttggagtcaataatcaaatataagcagggttacgaggtgtgaaaactacaaccttcaagctcaaggctgagaataaagaagagatcgatcaagataagaagtatagagggaaaataacatgtttatatgctcaatggttttatgctaaataacaacaatatgacagtgaacaaaactataatttatatcacaattgatgattacaaaatattttatatcaatcgattaaaaaatattttatatcagtcgattaaaaaaaaaattcagtttactacattaatctcttatatttcaaacaacaataagtttcatggttatcttcataatcaaattaaaatctagtactttaaaattttggaacaaattgagtttaagttgaaggcttaaaatagcaatcaggtgccattgtttcatacattatatatttaattattagagactccttgtttgttttatagattataatttgtttttttttatacttgatgtttaatgttcaaaacatgttttttttcttccacaaaaaacatgttgcttagaaacaactttttggtcatttaataaaacggaaaagaaagaaagaaattgctattcatactgaatcttaaaatgtttctcttcataattgtttttttctaacattatacaatttctatttagaattatgcatatctagataatttagactttaaagttgaaaatttagagaataaacaactaaataggaatgatgaagaaaaatatattttggttggaaacaatttaaatggagacgatcattataatgaatttaaatattttgatgacgtgagtcttaaaaaaatgaattctttcttcttctttttttatgaaacctagccagcatatattattggacatttttttttttacctaagaacatgaaataatcttataagtaacttacgagattaatcactaaaaatggtctaagaaaatacatcaattgtgaatgatcttaaggatattaaaagaaaaatgcgcatgattttaaataattacgtgacctctaactaataattttagtcaaatgagaaatttttttattatgagaaataagaactacaaatacaaatcactaaataatatttgaatagtcaaaatattcaaaaaagtaaatggtttttttaaatggtcatgtaaccgctaactaacatataatcgatcctaattaaataagaattcttgttattgtgagaaataaaaattacaaatataagtcaatagatcatattagaataatcaatagtaaaagaaaaatacacatatttttttatgtgtttattgaagtctgaatcatctatataattgtatgaactagatttagagtttttatttcttacaataagaaaagtattttaacttatacattacacatgataaatttttatttttatatagttaaaatttatagttaataaatattttttaatatataaatcgtattataaataaaattataataaacaaatcttttgaatatattaaccatatcttggatttagatgaatgttaaacggtcgacaagcacatcgaattatccaagtaataaataaatggtaagtctgagtgtcgaattccacaatgattttgcttgtattcagagttaatatatttttaattttaagcgaacacaaattaagtttgataatttctaatcctaatgcggaaatgtaaaattcaacataaataaagataattaagcataacacaataaagagatagaatacaaacacttgagattgaaatgtcaggtaatgcggaggattatgacgtgttggggctcaactcaccaaaactacctttgatgcaatattacaaatatttctctgtttaattattaaaattgctcaccatcatctactaatgtgttataaccttaattcctcaagtgttaggtcctaaattacctaatttcactcctgatccctcaacaagttccatcaaataatttgcattaagagtaaagatgcaaaatgtaacataggctaaacaaaaccactttatccctagacatgatattatttagaaatgtttttcagttctcattttccaatgcattaaaatcctataacaagcttgcaaataggagattaaaccacaatcatgaataaagctcagaaaaactacaatgatacgaaaataacattaaatagatagttagaatcattacatcaagagtgtttggttgttggaaccccaacaatggatgggttagcctcccatttccatgagagggtttacaaatacaaaagaaagcaagaagaatgaaagataatagaagaaaatggatgaagaggtccccaaatgagtgagatttctaccttcactcgtgccctagctctatctctggccctccaaaagtccagatcctttgcctcgtgcccttatttttccttttaacagcaacccaaagtcgtggtctgtgctcagtgcggaaaggtcgcgctgagcacgccttcattgtccagctgaataagtgaccacgcgctaagcaagctggtcgcgctgaccgggcctgtcgcactgagcgagcatctggcgcacttaacgagtagcttcagacccttaattgtcctttcattttcttgcagtgaaatttctacaaaaacacaatcaacaacttatgaatcaactaaacttaacatctacttgataaaagtttaggagaagttaatttctatattttaatcacaaaaagaagtcataaaagaatgaaaaaaaggataatttacttatagatttacattcgatcagcaattatcaatgaataatttaaaattgatataattaaggttacgtttaactatacacacatgtaatgacatattaagccacatatcaatctcttttttataggaattgtaaactgagaacataggtataggccaaattaaaaatgacatcacatatcatgaatggagaacaataggatggcctgaatgaagaactatttcacatgtaattaaggacatttaaaagctattttttgttgaaaacaagtgtcttgtacaaggataaaagttaaaatttagcctaataaatatgaatagaaaaaatataatttgaaacgtatatataaaattttattttaaaattattaaagaaaaaattaaaataataatcataaaaaaagcttaaatacctttatagtccttataatttaatttttttatccatgtaaatttttttatattttatttttagctcttgcgaattatgtttattttatttttcatctttacaacactttagatatcacttttttcattatccaaagtattatctaaagttatttaatgattaaaaataaaacaaacataatttataaggactaaaatcataaaaataattttataaggatgcaaaacaaaaaaatattaaattagaaagattaaaaagattttttaaatgaaaaaatatggataatctcatccatattttgtttctgaattaaaaaaaaattccaaacatttagcaaaacacattaagaggaaaaaagagtacatgtaatcacgttgagatgtctaaatattatataactttgttaatgctggtacttatttagaaaacacatatttatggattatatttggatttttctttgaaaaactcatcaaattaagttttaagcaaaaaaaaaaatactttttgttacttttgttcaaattatgatcttggaagatttaagtggaaaaaaaatcgattatacgttgagtatgtaaaacagttttattttaacacatcatcacaattataactcactattaagtttattgtcttttattataattattttaaaaatcatagtttgtggtaaaggattccacagataaacttgattattagcgagattttaaacatcattctcgctttataaaccaaatcactgaatttgtacacgcaattatcacttgttagagggatgtttgtgttgtgctattggcatagacaccattattgtggcataagcatgataacaaatactaatgtttgagtcatatctttcatcatcaaccgctcagcacctcatgtgggaggaattaatcaacacgttgaaaaatgggttttatgaaaaatacggtaactatacgaaattcgatgaaaaaccccagtcatcttcaattatgcttccattccatccaaggtaagtacaacaaaataaagaaaaagagggggaaaaaaatgttgaataaagtgatcacttgatcgcggcgtgcgtgtattgttcatgatgacaaacacggtctaagactaaatcccacagtctacactctacacgcaaataagggtttattccaatgttaactatgcaaattaaaagagttttaatttgttcaaaaactcaattattttgggaggtatgttcccactgaatcaattagcctagctattattcaccgacgacttttctttttctctttatttttcttgggtaaattctttaatctcagtttgtatttaatcatttgttaatataatcattcaatgatacattgacactttattgaaacaattaaacttgctaaagaattgttgtgatagttaaaaaaagttcctccgcataaaatacctgtagtctgaaaagaattagtattatctgttttctttgcatctccttggaatcttcagattgcatttattagttgaaatttgaaacttgtttctttcttcttctttatgtggcagtggcaccagccgtgacaaactggtaagcaatgttgggtgcgagaaaaatgacatcattagaacaaaagcatgacgcgtcccataatcgaactcataaattcaaaaatgccatggactagtaaagtccacattctgatgagtaattgagaaggaaaaaaagttatacaataaagtaaaaagagaaaaatgtaatagtaaaatctctcaaggcagaaaactgcaaaagaggaaagtgtatctgttaatataagaagaaatggttaatgtaatatttgcatctatcaaaaaatgatagtgtaaacaatattttggtaataaaaaatcataatgaaaattaatagaactttaaaagaaaatttttaaatgaaataaaatatcataaacttgaagttgtaaaatatatattaacataaaaaagaaagacaacaaaatatttatatctctcttaagtagagtttaatttattcaaataattgtatcttaatccattgcacataccattgaaatgggttatttacatatatttagtaagtatctagtgttaattatgcatgaaattagagtttgatgtctatgtattgataatgtaaaactgttttacacttcatttaatcataaatcaccatttgaattattttaaaaatcaacaaatttatcataaataattaattatgattaaataattgtgtaaaacattttacactaacaatacataactttttttttctcaattactcatcagaatataatatattttcatactttttcaaccaaatcccatatgtcatatattattaacattgttagtacatatctcaatttttcataatttttttataatatattttcagtcctaaatttttttctccactgaatgttatttttagcctttttatatattactaacaacgttttttttttataattctaataacaaatttagttacacattttatcactctcaaagcttttactttgcttgcaactccttaagaagagaaacaaccttaatgtgtagcaagaggtgaatggtaacttggtaaattaaaaatactttagtataattttaattaaaaatatattttaaaatattttaaagaatattctttaatgatattaagttaaatacactaaaattaaccccattaaacattatctagatatcatgttcttttcaaatccatacattatttataaaataatattaacaatatctttttaaaaataaatattaacaatatctgtaaccgttactaataaactttttatcaatagtagcagttaattatatcttttgatgcctgaaatattttttgcatatctcagcatgagctgagaataccccttggcagttggcacacgtatctgcaaaaattagactatattaaaatatctatataaaatgataagcacaagtattagctatcattatcatgattgccctactaggaatcagtcactagaagatatgaattatgaattatgaagcttgtgccaccaaaatcggaaagaaaacatctaacgtgataactgactatatgaattatgaagcttgtgccaccaaaatcatacccaactcaaattgaaagtgcaatttaggagtaatccacatactttatgtcttcttaattgggcatatatatgtttctcaaatccacaatagttcatataaaaggagaaacaatagtgaattattccacttgtttaccataacccaccatacttggccattattgcttccaatgctttgtcgaagcagggtttgtaataaggaacacaatgattattgctatggtaacaaagagatagcgtaatgacacccctcaaggagactcctaagtgggtgtaagatatgcaatcttcttagtttctagtttctgagtttattagtataatttaagagtctgtttggatgaagcaatttaaaattataaagaattttaaattttaagaatttcaaatgcttcaattgaaattctttcattttcaaaattctgtgttaggataataaaattaaatttcatcattttcaaaattttatatttggatgaagaaattaaattttcagcatcgttcaagatcgtgaacaagtgccgccacacgatatgctcaagattactctctctagcaccatctcaccgcctcatcccaccatcagattcaccctcaagagaggcaaatcaaataacgtaaaaatcctgaagtcttggtcgggtcggatatgggcacaaccctctacgaccaagactctgacaaaaaattctcttgcgccattgctgattgcggcttcggcaaagtatagtgcgttgggctgggtcaaacctccgacgacattggcagagttcactctcaatagtgccaatgggttggacttctacgacgtgagtttggtcgacggttacaaccttctaatgctgattatcgccaaggacagcaccaggtgcagcgccaccgattgtcttgcgacttcaacggcgggtgtccaatttcaatttcaatttcaatttcaatttctcactcttttagaaggaaattaaaatttcacatttttagttgtttaaaattatattttaaaatttaaaaaaaattaatttcttaaaaaaaaaattcaaataatgaattttagattattttcttttaattatctgaatttattttactcagttgaaattctctatctaaacggacttgagaaatctcaatagaaattggcacaattttaaatttactcattaatagcaactgcaattaatcgaaaagatgacgccaaaaaatcttctatggtagtgtagttagtgcctgttgaaatcacgaattcaaaatccagctaaagatccaccattttgtttagtattgtcaaatcggggaaaccgacccattttgtgccactcattgtgagtaaagtcaaatataatttgttaggtgcatgtatcgtttaccttaccgtacacatgttacaatttaacaagtagtcaagtactcgtttgataatgttcaaaagttactaaatatgctttaaatttaaattatttttaaaagacacatttattctccatgaaagatattttttctcgaatcagatcatattactacatgctgaaagtaaaactttttctttaagtatttagactatatatagtcaaaactcaaacacaagagacacggattaaacaataataactatgcaccacattatctatgtgtttagtggttctctaattttaacttgttgacattaacatacatttttttttatcatattataagtataaagtatccattaacaaaatatttaatatatatttatataattatgccaaaaatgttattttttaataatttattttatttaatacaaaacaaactaatttgcaatattagatctaatgtaaattactattatttaagttttttttttttttcaaaacgatatttaagtaaaacttagtagttgtacaaattttttgacatcttcaaacttactaatcaagccagctcaaaattggttccggttgaattggatattcagtatcgctatttgttaagtacatttagaatcagaagggatagtaaaaattgtttatattgaaacaatcaaaccatgtatatgctctagatagttttcgggaaaattgttaatctaatgccaaatgcaccccaacaagtattaaatataaatatatcttacaccaaaagatacaaaatacacatctaaaaagaattcatagatatataccacgcgggcttttgtgctcatagtatccaacccgagaagcaattgaggaactaagaatggacaagcgtagctacaacaaataagattgaaagaatttgctccttttaagaagaacaaaaaaaaatgtggattgttcatctagtctgaagccaaaagcttcatgccactcaaacctagaagagatgtggaaaatagagggttgagaccaccaaaagcaactttttctccattttttttttttttttttgttttttcttagaaggaagtttagagatgattttactcaaagcagaagaagagaagctataaacacagcgagagtggacaagaagaagcagacagtgaccttaggctgtgaatttccctgtggtgatttggttccggcattcgggctggaagctggggctattttagcaacaggaggcaaaggtggctctgccacttcagattctgtcaagggtggaaacggagcctcggctggaggcaagaattctttggtaatgagtccaaaaagaccacctggttgaacaggttccatgtaagtaggtttgttgtcacccaaacctaagcatttgttccctgcagtagaacggagaaaaattatttcagtaaaaactgtttatattgaaacaatcaacccatggtacagcagaatttgctagcacttacttctgtatctgtcagcagttttagggaagtctgtgatgataccatcaatttgtgctccctcaatatatgagttgatctcaacagttgcatctgagaagaaatcccatgcttgagacacaaactcattgctgaatgtttctacaaaaactgagaggttagcattttttagctttggcacaatatttgtataggccgtcaggaattgatcattattaggaattacggagtccttgttgacaaccacagaactagcaaagttctttatatcctcaacagctgcatttgcagcatcaccaacagtctcgtcaatcttgtacacaagctcataactggttttctccttgaacttcagcagtacagaactattagtggattgaatataaaccttttgggatcctggtttatcataacctgctttgctcaaaacatcgatgacagcatcaatcacacttaatccttgcttgtctgcaagataggctgcattctgataagaagaacaacaacaacaacacaatatacatgttagtaaatagaagatgaaagaaaaggaaaaaaaatcatttgcacacaaggaacatgccaaataattctttacttggttgaaataaatcagggtgaatagagtcagtgaagaaatatttgatgttaaattcacacgagtttggcaggtgagtcattttgtttttggtttcaaaagagaaagttgtcagctgcatgaagtacaagtagaactccaaagagttaaaaacagtatatttcataatttttggccaacaaaaacaagtgagaaacaggtcttgtaacaatttgatagaaataatgcatgatagtcttaatatttcttatttctatttcccctcttattccaaggtgaaatcattcataggaattattaaataacttaagtgaccctaagccgttctcacaaaaatttgtcctaattcttcaaacaaaattatatgttcaaataacagccggtagaatgaatactacaaaaagaatgaataggcacggaagcacacacctcaacaatgatagcaacacctgatagagaagtctgattttttgtcaaggacaagaaatctgataatgccaacaatgtcccagcattcttagattttggattcctgaacaatctgtattttgcaaaaggattcaatattgaggctgcagggaaaatagagaagagaaaaatatgtcaaatatttgttataacacttatcataggcagcaagtgaaaggcaccaaaagatatgagagggaaaattttgccatggtaatttatcagtgagacattaattgtcctataaagtgaagttgtaagctaatttccccattattcccaaaacacgacttgtttcaatgttcatatatctcattctgaattttggctatatgacgtatcagtcaactaagctttgacaaagtagggatgccaaattattgattccattaggctttttgcttcatgggtttggttcttgtccccccatctgttgtttttatgttcctcttctttttggttaatatatttccagtgtgcagtaagtgattgttagttgctttggtgccaacatagttgggattaaagaaactaaagtgatgcatttgcatgctgttttgtttaaaaaataatattgtgattttagtccccctagtttctcaaattcatgattttggttccctgaattttaattcatagtcttataaattggtgattttggtcttccagatagattattaacaaataattatcattaattgagttattaaatcaattataaattaatcaaaaccattaattattaaaaattgaataaaaattattaatcctaattttctgcaacactgttcttcctcttctctgcaaatacctcttctatctccattgtgtcgcacgcgactccaccagcagtaacaccacattaggtttaatagtgttttatcaaagcctttttaatgattaataatttttatttaatttataattaatttaatctctctaataatcataattattaaccaaaatcacaaattcataaaactaggggaccaaatgttacaattaaaaatcaaggggaccaaaatcatggatttggaaaactagggggaccaaaattgcaattcagccaaaataataattaagctttgacaagtctggattaactccatgcaaatacagaaataaatagctaacaactacagaactttcagacttacgggtcaagctttttatatcattccatgtcaagttgaatgcaaatatgccactgccagatttgatctcggggatagtcatggcaaatttgctgaagcttgattgggtgactgttgtactctctataagatcaatggagtttaagcaaaatggtgttccatccttagacatttgaacaggacagtcaagaacatccacaccatcagatatggccttattatatgctaagtcggtacaagcaggataatctccactcgctccatattttgagataaccaaagttttatctgaaacatgataaaaaagtgagagaaacaaatcatcaataatgcaagctatgcttccatcgaatgataaaaatcatacagtcaaacaactagaaatcactaagaacaacatgataatacatattccaaaatcaaaacaagttaccttttttcgtagcattggtgcctaggtgagcaaagcaacctgcattataagaagacaacacagtatctacttaaatagagaaaaaaaaaaggattggaaacacaaacatacagacatgttctgagattacaatttataagtatgcagtaggacccacaagcgactaatatcaactacatgcttatgtcttatgcttatatgatgtaaaagcattttaaaattgagaaagaaaattctaattaggatagctaataagaatgcaatgcctagaaggcaaacatcgctatgtgctttcatgcagcatgacaaaatcttttactatagttgattaaagagtatataactggaccatatctgatctgcctaaaggagcctgccctaagctgaatttagtttacagtgggagcttgaaagcaggaggtggtgagagattggctaaaagtacatatttttagtaactttgttcatgcacttgcaccagcattcggacatgaaatcctttagtcaaagtcaacataaatcccatctgtatccttccattgattaaggattgcataacaatcttagtggcatactcatgcaaagtgaaagtatctgcttacaaagattggatagtaaggataaattagcttataaatatatcagttttgggcagattgatcagtaaaacaatttcactgaggattaaaattgaggatttgccccatgaagtttaaacaagccatccgtggccactctaaaattgaaaaggcaagcaaatgcaagaggcacgtttaaggtgattcacacaaacactatgagcatgagattaggaagacattaggataattttatttaatggaaccttatagctgcatcaactccatcccaagggacaaatactgtatatagtaaaaatctgaaaatatatgcaaggatatgtttggttggaagagtttgaaggggaagtgatgacagcagatttttcatttataaaatgtttacaaaaacgaataagtgatgattggcaagttacactataatctgattatacccccccccccccccagttctgttatttaagaaaatcttaaataattagaatgtttacataaaacaaatattgtctcccttctaaactcttgcaaccaagcataccctacgtctacgtaaacaacattttgataaaatcaaatgcattctaattgtggcaggctattctgataacatggcagaataaacaaataaacagcttacctatagcttcaaatggagttatgggaaaatcagagagcacaccatcaacagagaagtcaccattgtctacaaattggaggtactcggcaagaggatcataactgtaattgaagctagatggaacatcgttcacaaaatctgatgcaaaaacttctagccctgctttatgtgcatctgagaccaaagatgtatgtggttgtagataaagagttgcatgatctacaggccatatgtatccctttggaacaagaattccagaagcaaatgtcttgataaatgtaagattttttaaaagcgaaccataagtccgattggttgatggatctacatcactctgtcccataaacctgaagaccaattttgttgtttttgggttgaagcgtgatgctatacttctcagaaaaccaacctcaggtgatgagatataactgaaaactactcttctagaaactgaaatcacaaagcttcgcatactcaaattgtgttgtgcgtagaatgcatcatgctttaaaatataagagaaaacaagagttagatttaaaacaaggagactgaatgatgagaatggattatgcattcattctatttacctgaatattcaaccatattccttttggtttttgcgttaatttaactaaatcatcaacagtaagaattccaaaattgttgccatcatacaggttggatcgagagtatactccctgagttactgtccagaaacaagaaactgtcagcaactatataaagaaacaacttccctatccaaaaagaaaaaagaaacaacttcaaagctcatttgcaagctgagacagaaaagggtttaaaaagatcctgattagaagctaaaccttaaatcaacaacacatatatacaccgcagaaaagaatcactcagtccatcaaatactgaaagtttataactattaggaataaaactacatgtttgaaataaactaaactcacagacaacactagataggtccttcagagtataatccagaggaaaatagccacgggtgggtacaccattaactaagtaacttgtggttttatttgggtaagcggttgcaatgtaagtagaatttgcaaggtttatatctggctggcaaatcccaactccatcttttgttaattgcacatcacaccatatatagacatctggtccactcgttattactgccaaattataggcagcatcactggaatcaggaagtatccccgaaaatccaccacgtgctacaaccaacggcgcacctcctgcaaaacaagtatacaagtaagtttcaaaacacctaacacagtgaaagttcctccttaaataataataataataaaaagtgcaaaagttattcaagaacatattctaaaactgaaagtggcaacagtctctgatattatatgaatcgtattcagtcagcgattggcctttagatttcatggaaaaaattgtttgttgaagatcctacatcagactaatgatatggcaaaaaagagtgtataaatagggggcaaccctcatttcttaagctagcatttaagattgaatatgacaacccaaattctaaattctaaaacaggtattggagctgatcctagcgatcattgttgaatctattgggtcaaccgttaagtcatgcaagcttcacatcgaagatgtctagtccttggcgtggagaaggctagctagcttttgaggttgagttaggctcaaacccaaattgtaagagttgaatccgcaaacagttcattcagccaaaactttccctgacaacaaataactaatgtttccttttcacatatgatattctcagattaagctctcgagaaacgtcaaactctttctaagcactgcatataatatctccatagaccataaactagctcgaagcttagctaagccatttatccaaatccgaactcaggtcaaagtaacaaacgaaatcaaagtttacaaaaaaaagaaaaacacagatcgtacacttggttagtgattattaggtaagtaaatagtaagtgaaaagagacagaagcaaagatggtagtaaaacacgagacattaccgctgagagtgttccagatagatctctgagcagagacgagagaaaggagcgagtgaagaagaagcagagcgagtggcgcagagagagcgcgtgaattccacatcccggcaaccttggcacttggcagattaagaccaggagcaagtgatgaacccaaccacctcaaaacttttagagagagaaagtgtgtgtgagacaatgaggtcttaactcagcagaagaactttttctgaagtggtggccttttagtattttctttcttgcatttatcattgtgttctgttgtgtatttacatatatatagtattatttaaatttttttttcactgatcaaatcttttcattcataaaatttgaaaacaagatctttaaagactgaattcactggaaccaatgactaattagtgttgttggaggtattaatattgtagtgttatttaatagtgtagtctgaaaaatataaataaaagtaaaaaaaaaaatgtggggcgaagtggacaagctggcttgagctaagccgcggttttgactgatgtagtatgtggtgcggagtggggtccacaacgtggttgtcaaactctggcaaggtatacgtggcgggctgtgattggtgctgaggaaacgcacaaaaccgcaaggttctaagatcatatttggtggcatcttcaactatttttgttagactatataatgttaatgaagatcttttaaaaaaaaattatttttttagtagtagattttattttaaaattattatttttaaaataatatatagatattaaaaattcttttaaaaaacttattttttatgttaaaaatctattgacttcatttattaaaagatatagtaaatatcatatattgaattcaatatttaatagtaaaaatgttctacgtgggtgtccaccgtagaagaacaacgtgcgaccgtgaattgcgactctgatttgatggtggtgaggtgagggtgagtgggtttcatttcatttttgatgctattgccgagtgagactgctcccactgcattgcacacttttattcgttctttttcaagtactttgtcaaagtccaacatgttcagaatatatgtggtattagatactacagttactcttcatcaccacttttgattattacattaaaatctaaccatagataagaacatatatctcgtttctttctcatcttcatgacaacgagtttgtggtcattaatttgaattgtgatgatggacctggtccagttgcataaattaaatgatctgtctatgtttggttttatcgtgttatgacatattgacgttgaaaactcattttgaggccatgactatttcaaaaggccaaatattacttaattattttagatttgtctcattaatttttattatttatttattaagcagtgatatacatataataatttttttaatctattacatcatttatttttttttcttctcttccgaaatttctctttgcatgcgctgaattatatatatatgtaagagtattcttacccgtttttttaatattagtggttagctcaccaaaaaaatatattagtggttagctggaaggctctttaaatgttcgtccttaaactagagaagaaaaaagagcaaggcacaaagtatacgttgcaccactttctgaattgtaatcctccctatccatgtggtttcaatatatatatatatatatatatatatatatatatatatatatatattatatttaggggtgtgaaaaagaattaattctgatggaatcggattgtaatcgaacttgaatcaaattaattttttctcgacttagtttaagaaaaaaaatagtacactatcttataaaactattttgattaatcaaattgtttctataaaatcgattcggttaatcaaactgaatttcatttgaatatttttttatttgaaaaaaatagttcgaaattggttttatttgttcttaaaatcagattaaaattgattaaaagttaattcgatacatagctaattttttaaaactagattgttctttaaacggttttcaaattaatttgactatttgaatataaaactgaatcgattaacacagaccaatttagttcgatttttttaccatactaatttttgcacaccttactattattggaagtaataaacattttatactctttttgataaacttttctttttctttttcaagtgactaaataaattataaatctcaatgaaaagttaatcagtttttcttagtgaattatacgcataaattggataaataagtttaatcaaaattaattaatacatctgtaatacattttgagtatggcataaaggcacctaagaactagaatttcaaggaaatagcaagaggggcaaatctgtgaagataaggtgaacaatgaaagacatggattgtataagaaggaaattattgacgggtagggaattatcagaaaaagacatcgagaataaagaatctaattcgatggttgttacttgttagtgttctaagacagaaacttacaagttagacaaactggagttatggcaacttaaacgagtttacttttcaatgaaatgctgtcattgcattattgatattgcatgcttggccagactaggaattttccttgttcctatggacgaattctctgcaactcttgggttactttttctactcaagttatattaatatattccttttgctttccaaaaaaaatgtagaagtttcaagatgaaaaatcaaacctaaatcccattgacttccaagtcaattctactaatgctgttagaaacaatcttaatatatatagcgttatagatggggtagaaaatggatgtttatatgatatataataaagaaaaagaaactccaaaatagataaaaaatcaaaccattcaaatacctatgcctcatctttgcagacaataacctccaagtcaatgtaacatagtggcagtaaagggaattaatgacacattatagagtagaaaatggaaaaatattagcgcagtgaaaggattagaaaaatgaataatgtttgtttgcgtgagggatgggctcttgcatctagtgtttttaatctggctataaatattcatctttggttgcttaccctttcaaataaattttcctttgaagtaagttagaatggagtcaatgtgatggatggggtggttgtttctgtgtaggcatttgttactcgagtctctaaatttgtgcaacaacaagctacggggcaatattccaaaatccatgttcagccttgtaaaccttactcacttgtgtctatcaccttactcacttgtgtctatcatcaaacaacttcagtggatctgtccactttccactcttctccaagcttcataatttggaaaaattttccctttcgcacaatgatcaattatcactaaatttcaaatccaatgtcaattacagtttctcctgcttaactagtttggacctatcttttataggtttatctgaatttccaaaattatcggccggtaaaagttccaatttggggatctcttgatatgtccattaacaaacttagtggaagagtgcccaattgattacatgaaatgatttcattctattatttggacctctctcaaaacctgttgacaacaccaatggaccaattctcaaggaactaccaactctattaccttgatattagtttcaactcaaacactggtggcatctcttcgtcaatttgcaatgcaagtttacttcagagtctcagcttgtcccacaacaaattgacaggcatcattccccaatgcctttcaaacttatcatcccttcaagtattagatttacagatgaacaaattttatggcactttacctagtaccttttcgaagaaaagtttgctcggtactttgaatctcaatggcaaccaattttgaaggtcttttgccaaaatctttgtccaattgcacagaagtggatttttaaatcttggcaacaatcaaattgaggatacatttcccccttggcttcaaactctaccatatttggaagtattggttttgcaagccaataagttgcacggtcccattcccagttaaagaccaagcatccatttcgaagtttagttatttttgatatctcatccaacaacttcattggcccaataccaaaatcctacatacaaaattttgaagccatgaagaatgtcgtccaagataaagtgggtaacggtttgcaggaatacatggaaacatctataatgaatggaacatacactgattctgtgactgtaacaatgaaagccattagtatgacactcaacaaaatccaaacaaactttgtaagcattgatttatcaggaaacaaatttgaaggagaaattccgaatgttattggagagcttcatgcactcagagggctcaacctttcccataacagactatgcagtcctattccccaatccctgggaaatttgacaaacttggaatcattggatctctcctcaaatattctcactggtaggattcctacagaattaaccgatttgaactttcttgaagtactcaatctttcccataaccatcttgtaggagaaatacctcatggaaaacagttcaatacttttttgaatgattcttatgagggaaatttggggttatgtggagtccaattgtcaatgaaatgcaacaatgaccgtgaacaacattctccatcttcaccgaccttgtggagagaagagaaatttggatttggttggaaaccagtggctataggatatggatgtggaatggtatttggagtgggcatgggatgttgtgtgttattaataggaaagcctcaatggcttgtaagaatggttagaggtcaacttaataaaaaggtgaaaaagaagacaaggatgagaactcatgaaattgtagcagaatgaattagtggatatctggcatggctggaatttgtcttgttcctcactttcctgttcaattccatttctgccttcttcgaaaacaaaaaacttaagggcaaaaagcttatcacattgcattgcaggggagatctgattcaaatttttgtaatatgaatgtcatatttttcatttggtataatttgtttgccttcgatcttgcaattttgttttatttaatacatataattgtcgatattggttatatattactagcggttgttgtatacttttaaaactgtttatatgtaccggtcattgctagaatatttgtgtcttaacattatggaattgtctcattttgttcaagtatttcatttcgcatcttcatcttctaatatagtctatttagttttctatacttgcttctagtgttgtttttcagccaagtacattatctatgtactcaccttaactaattgattttctagttttacattaacaaaaccattagcacaaaaggattattaaagatctccataaaaattctctgtgatctaacaatagaaggcagataagtgttttgacgaaagaaaagttcgatggacggttggactgcataacagaggttggaacttggaagatctgagaacacattttattaaaaccaatctacctgccaatgagaactttggatttccacatattctaagctttgatgtagctttgtccagaatccctttgaaggagtctctagccactctgtcattgatgtataagaactcccaaatattttccctaagttatccatcctaccaaaactgaatttagtgctaatctgatctctaattctccatacttggagaaaaaaagatctttatcttatccctgctaatcacttgaccccagctagagcagaaactgctaaatctctctaatgtgactcccgagttacttgttgccttgctattgattcttttttgttcttttggggcctttaatgtttgatactatgatggaattctcttgaactcttgtttgaaacttgaaatctaaacctgccattatgacatggttaagaacatatttacttcggatgttttcatcccacgtatagcttgttgtctttgtttaatgaagctagatcatcaattgggtttgagtgtcttagaaaaactcacattacttctactcatctcatactgatgcggaaatgttgtgaaggatgcattactatctatattttttaaatattatttattactattattatggtgttttgtttattgagtttcttctcagaaccaagaaccaaacattttatataaacatatttcaagttccagaggaaaggaataatagacgtctggatattttgtagacatggagggaaaagagtaatgagattttgtattcttgtacattaaacacctttgcaacatctacaacatcaggcactaatacaccacacgtctacttgcaaacttttgggcaaaacacgttgattaaaatgaactgcacctttattggagggacatcagatgctgtcttaaaacttggaagcttctttaagtgttaaaatgaaacaccagacagcaattgaagactaagaggttcttaattgtaatggaaaaatctatagaggcaaggcagattgactagactgtgccatactctccttaaccaggtgttgagcttgcttaattctcaaatttgctcctttcatgagcttctaattgagacattgggctaaggtgtgcccaaatgaaccttgtcttcctgcaataagttcaatgaaaatatactgttagggatgtgcagcaatctgctgtggagatattccaacatttggcagtgttcagtggcaaaggataaagaaaacatttggcagtttaccaagtgccaacaggcttaatgttttcaagtttgaccttttcataagctactcattagcttgtttttgacaaattgcacaaaggaagatgatgtattcttatcacgatatactgtttgcattatactaaaaccccacaaaaaacaaccctattaagtgttcatggatgctttaatactataactaataagagttcatgccccagcctgcagataggagagagagggttggcagaaggaagaggtgaccaagttgccataaaggtggtatttgctgaagtacatttttatttctttgaaatttgatgctttgttgatttaagacctatgctccaatccaaaagtatgaggcaacctgtataaaggatttataatatttttctcaacaatctgttatttccctcacaatgttgacaactcgtgaaaacattgagattttaaacaatgttaaattgtttgtgctaaaaacactaccttgcacatgccgtatgtaattcagtagcatatccatccttgttcttctacaatgcattcctgtaatagttgtcttggaaattgagagaaatattgctgatggggatcatattacttggacttgtttaaatccaagtcataagtgtttttaagagtttttctagtaaagaaattcttaaaaatacttatagtcttgtatccaaacagactccttgtcttgatcagcaagagcattctttaacttaggctccaacagctattgggatcttgattcatcatacttccacccgttacattcattagtcacttgttcactttatcgaatacatgataatgagtagtgctgtaccatcacgaggagcttcgcgaatactgcaattccaacggtgacaaatatcacgggcatgttggtggtgtcaacaatcatgtcctttctcgttgttctgcttatcttccttttcttctccattattatgttgttttctctgaaactcaaaataaaggaatgaagctagtagacgaaattcatgcaggaaagaatgagtttggagactgtaacttcttattgttctttatccaaatattgagttcaattcatggatgtataatgacaataatacactaattgcggagaagagagctacaaaagttttaattaatgtcataaattgtaatgacaataacatacaaattgcaaaaatgagtgtcacgccatttaagcagctcgacccagagtactttggttttagtgacaatttcaatgaacaagagtgtaatggcaccaattatagaaacctttgatgttaaatgagagttattggaagaattgtagaaaagaatgacacgtagcaaaacatgtgatgtaaaaaaattatataaacatgcaatattatattttgcaactctaaatttatatatggtaaatagataaatagtcaagtattagaaataagttacatatgtttggataatagtgatcaaaatcaagtcttataattataacatgtgttttattttaatacaataaactgtataagatattaattaaaaactatatttaaactatttaataatttaaaatcaattatatgtaactttaaaacaagcatccttcatctttttattgttttcagcaaagttaacaaaagatttctgataagaaaaacaaatgatatttaatattcttaaggtttaatttttatgtattataagtaaaaattcggtacctatcagtcatttagaattattgttaatttaatttttaaaataattattataaaagttattgcattcaatttttttaggacaacagtgaatccactattcattctttgaccttttttataaaaatataacagaattacgataaaattgaccatgctataaattgaaaaggtagtaatttgcttgaataaaaaattggacacgagatcttatggaatataaatatagcaagaaccttgacaaaaaaaaatgtaataatataatgttgcgtaatgcattgttcactttgtcacaaaccgaatcccagctgtgatgatgaacatgcccgccataacgacgcttgttttttgctgagatcacaaagtcggttccacaaaacaccaaaaaaactatacacctagagaacgacgtgtgcgaagcgtagagcgagttcaagatactctcgcggttaacccacgcgcgcaatctgaaaccaaaccaacaacaacaaaaaataaaaataaaaacaagacagtcatagactcatagcataggacttgggagtcacacggtcggttctcttctctgtcactttgcctacccactaagaaaaatcgatcctttcttctcttccttgcgcatctcttctcttcattcaattcaattgtggtgttagtgaaataataatgaaggggtagttgagcattcaaacaacccataccctcatttttatgtgtgggtatgttctcattattattttcattcactcattaacttcaacaaatgcatacaattactacaatgttgtatctgcttctgcgtggttctcactcaagttcttatctttcttcccttcttcctcgatctcaatcttcccaactggattttgctctgcggggggaggggtaaataactcaatacccatgagacttgctatactttcgttgaaaaaccattggatagatgtgaaatgcgtcataccctttttctgtgtttgatggaattgagcttctggtcattgtttttatgatggttttttttttttttaataactaatccaacgaactctcttatttcattttattttaatcttttgtgtcttatatcgttgttctgttttttttttcttttcctttttaagcttatcttttgtttgtgttgtctgtcaggataacgttggacaggttggtgactccgggagctaaaccacttcttgtttgggatttgttgtagatttggccttatatttgaattagaccgtgtagaattgcatctggcaataggttgttgagtcgtacgcataacgcattgttttgtgttacaaatattcttaagcttttctggggaatttttgtggtttgggggataccatacaatttgtagctttggtttgtgattctccaagatgtcaaaatttgagggtgttattgtctccgatcaatggcttcaaagccagttcacgcaagttgagcttcgcagcctgaaatccaaagtaggttcatttcattgcttccttgtaatcgacattttagtccaatttcattactcttttaaatttgttgtctttcatgctttgtgtttttttttttttttttttttttttttttttaaccttattggacccttctttctgttgttgtagtttgtctctttaaagaatcagaaaggtaaagttacatttggagatttgccgcctttaatggtgaagctaaatgcattcagagacatgtacggtgaggatgagattagggggatcttgggtgaatcaggcactgattttaccaatgacattgattttgaagctttcttaaaggttagtaatttggtgtttttgactttttctttttttaatattactacattaggtaacttttttccatgttgtgaacttataataatgggatattatgtgtaagttagttgtattaatgaaacagtttatgtgccatataacaacattaaatataatgttatgtagccttacaatttattacatttttcatgcaggcatatttgaatttgcaaagccaagctactacaaaacaaggtggtaggaggcactcctcgtcgttcctcaaggaaaccgtgaccacccttcttcacacgatcggtgaatcagaaaaggcttgctatgttgcccacataaacagctaccttggtgatgatccatttttgaaggaatatcttcctttggacccagctacaaatgatatatttgatcttgcaaaagatggcgttcttctgtggtatataagcagggtctgctgattgttgcattttacttatgtctgtatgagcctttaatgtatattggctttgatatatgtcgtgtttaatgcagtaaacttatcaatgttgctgtgcctgggacaatagatgagcgagccatcaattgcaaacggaatcctagtctttgggaggtaaacgagaaccatactctatgcctcaattccgccaaggctattggctgcacagtggttaacattggcgcacaggacttagttgaaggaagagtgagttttagcaatacgcacttcccctattcctctatagacatttacttaggttcttaatttttattctttgtgacattattgtttgggtgtttatgttgcagcctcatcttgttctagggttgatttcccaaatcataaaggtaaatatttgaactgcacatatcattcgtttattgttagtttagtggttgattttgcttatatgtttacatcatttttcttaatggcctaatatatcttttgacttcagaaatgattacatagtcattgttctcttttcctctcaatctcttggtaatttcagattcagctgctggctgatctcaaccttaagaagacacctcagcttgtggaattggttgatgacaacgaggtaataagatacgcattttttttctttaatttttatttccaattaaatcaaattttgatgtttcattctttgcacattgtgtttcaggataactgatgtattttgcatttcattgttgtcttaggagatcgaagagcttcttaatttgtctcctgaaaaggttctactaaaatggatgaattttcatctccagagagcgggttacgagaaaactgtcagaaatttttcttctgatgttaaggtatatgagtataggtataaatttgtacaatgagtattgataagtaaaaaatatatctattatataaggtacaaacattgcataaatgagtatcattgggcccctatatttaaaacaatcagggtacttttagcagatttttgatgttcaaagggcttttacaaatattcagttccctgttggaacttgggtgtctcccagtcctacttgtccttcataatctcatactattcaaagtatggatgttaaaatgtggtcttgaaaatattaattactgctgttctcctccccttaaaaaatctgcattgcaaattttggattttttacttattaaccttgaactgaacctgctaaggcttctctgctcacaacaaataatggttgtttgtaccttgtataatgcatatattttttgtaacaaattgttaatgtattcttaaaaggtaactgtcacatatattattcttatggggtaaatgggcaacatgaccataaatatattcatgtccatacatatacacacacgcacatgcacaccacactttgacagctagatgcttttagtacatatatacttgaataacaatcccgtctatcccacttcatggaatgggagtatctaagtgtgtaatgcatgacatagaatggaaatgtgacctttgaccatgtcatattgcttaatatgttttaagaggttgttcactcggcaaaaaatccaattccaatttttcatatgtttgttcctgcagaattgcaatttcttcaactcccaacttctaagccaatagtgtcataactcatgatagttttgcctctacaatttgaaattgaatcaagctattaacaaaccattatcctaatgtgttcacacccatttatttacaggatggagaggcctatgcttatctgcttaatgtccttgctcctgaacattgcagtccggccaccttggataccaaggatgccaatgaaagggcaaatctggttcttgatcacgcagagagaatgggctgcaaaagatacctgaccccaagcgatgttgcagagggtacttcaaatttgaatcttgcatttgttgcacaattgtttcatcataggtataaaatgaattgcatagttaattttatgcagactatttgataatttaaataaatattcttatgcatgttaatttctgaatctgtttaagtgctgtagttatttaattagtgccctacacattgcaggagtggtctatctacagacactaaaaagatgtcctatgctgagatgatgacagatgatgtgcaaacatctagagaagagagatgcttccgactgtggatcaatagtcttggaatttctacacatgtaaataatctgtttgaggatgtcaagaatgggtatgtgttccttttcttaaactgcatttattatttttggcaaaatctaaatccttgtatatctgtagaagtgtaaatttttaattttctggatctcaaaacataccaaatgatccacatggcacgtgtttatccactgattgggaaaaattaaatgaatgtgttatcaaaatttaatttgttaattcactaagttcttatgtgcttgattccttttactttatgcatgtagatggatacttttagaagtgttagacaagatatttccaggatcagttaactggaaacatgcaacaagacctccaattagaatgccattcagaaaagtagagaactgcaatcaggtcataaaaattggtaaacaactgagattctcactagtcaatgtagctggtaatgacattgtgcaaggaaataagaagctcattcttggtaatctcttcatatggatataatttactcttattttttataaattttttatgaccgctttcccacctatttgttttggctttcaattttatctaaaatatttttttccagctttattgtggcagctcatgcgattcacaatgcttcaactgttgaaaaatttgagatctcattcccaaggaaaggagatcactgatgctgatattctgaaatgggtgaacagaaaagtgaagagcattggcagaacttcccacatagagagcttcaaggttttttccaaaagaaattctctgttttatttgctgttaacaattcccaacaactgtaaactataaaataatgatttatccgtgacaaatttttgtatcaaattttttgcacaggataagagcttgtcaagtggactctttttccttgagcttctgagtgctgttgagcctaggattgtcaattggaaccttgtcaccaagggtgaaagcggtatgattctttatagggatattaaacagatcctttgtataacatgtaattacttgctactttttttcatccctcctaaattggcttaatttgttgtaattgtagatgatgagaagaggttgaatgccacttatataatcagtgttgcacggaagctcggttgttccatatttttgttacctgaggatattatggaggtatgttgcctcttgccacctgagagtttcattcatatttgctacaaaaatttatacacattagtcttctttgaataaacttcataagttcttataagagaaacaagcaaggtaaaataatttaaatttctcccgtaattaaaatcaaactttacacttcagcttttataaaaagttcttttatttaagttctccaaaagctaagtgtataaattgatttaaacttatgggtgaaatttaattcattttatcttattttcttcttctacaagtgtttatgcagaacttcattcaaacaaggccatcatgtaatttggcaatgataccaaaaaattaagttgacacattctgggttcagtttgtttatgatgtgattgattctttgttgatatcatggcaggttaatcagaagatgattctcactcttgcagccagtataatgtattggagcctgcaacaacagactgaagacatggattcatttccttcacctggcggcactgctactaccaccacgcccgaagcatccctggcaccttcggtatgtggtgaagatgaaagttctgccattggtggcgaattctccaacttgagtgttgacgatgccacctctgacaccacagccacttcttcacaacccgagtctgacagcgtttctgtgggagatgagctgttatgagtcatctagttggcatgagatgagtgttaaatgtttttgttaaagggagaatataacgagtaatgaacttgcaaagcttaagaaacaccttcacaatggtctcaaccttcaaaaaagttggggatgaaaacatacctttagaatagtatatgtgaatagtctgtacaaaaatatctttgttctttggagagaaatgcttattcagagggataagaatgaataaagcttagaggggaagaaagaaatgaatgtgatcaattcacacttgtcccttatattgcctttaagtaggttccactactgtatttgtattttgtcattcattacgttatgatggccaacaatggtgaccatttaccgtgtcaaataaacagaaaatttataactagttctcattcattcttacacggaattataaggtttaagctgataaaagcatgggaaaaagattaaatgctgtgtgaatgtctcaaagccttgacatattttttctgtcgatagattcgttaaacgaggtggatttgttgattttttatttttttgcggtataggttaggtttttaatctaccaatgttttgacttatcccactcaatctgtcaaagaacacctgtgaatatgtttttctttttcttttgggatttattggtaattatcatataaatagtctttcatgatttttgtgtttggattgtattagaaatattttaggataagatggatataaaagtgatgataagagaaatataagttttaatttaacattttttagtacattagataacattattgtactatcttgtccttatgtgataaaagttaaatagataatagtggtagtgatgataatgatattattgatgatatcaatttataacaatgttaataataatgatatcagtgtggtgatatcaatctataataatggttataatgacgaaataatgatgataataatgataatagttataataagagtgatagtaatgataatgatgataataaaaattatgatggaaaagtgatagagattatggtaagctagtgataattactggttagaaaaaagatgaaatatgtaaattcatttcaataaattgggttaaaaattctaatcgattttcacaaataacaaaaattgaaaacagattaacaaaagaacctactaaatatacattatattatgttatcttacctgtatgtgtgtatggatatatatcttagagtttaatggttacgtattttcgaaaaaaattggacacgggtcctctcacgttgaaaaaatctggagtgtcaattgaagaaatatacattgttgatcaaaatgagtggacaggatctgttcatacaaaacttagttctcaactgctgtactactttctttgacgcagaaagagaaaagtaaaacattcatttactaaaaaaagtattatattttcaataaaaaagttcttaaaaatacctctaacttatattcaaatagattttatatatttattcattaaaaagaaattacttatttctctgatcgcacgaacaagatgtccatgtctaggtcatggtgcttattcgagccctctaagcatatgaacatgtcatagcatatgaacattgtgatattaagaatataaattttctattttatataaaagagttttaattctatttttttacgtttcataatgtttagtaaataatttaaattttctacccgtcagcatgtgcacactaaaaagaaggagaaaaaaaaatcttgaccagcagatttaagaatagaaatctgtactatgcgcgatggtccgaatggttattggtcgataacaattaataaagctgttccattccacaagtgccaccaaaatcattgggatattaagaattcaggcgagaaggggatcaagaacaaagaagaataatagaagtatcaaaatgtatggaaatggaaggagaaatgaaggtatgggtttgaatcctagcttccctatgttactgttatttcatatcatgaagggtccctctccccagtgttgtacctattcaccatcctaccccttcaacccaccactgtcctcccaacaggtgtcactgccttcttcatcacttgggtcaccaactccaaactcctcctcttcactttctctcctttgcatgcctcccaaatagactcaccccaaaaacaaaacccatcaaaatcaaaattaaaatttcatttcattatttttccaatcaaggccttgctttttggtctctcactcataggccttaaagaccactacaaacaaaaacttcaccctacaattattttgggcatatattgcaccctcatgtatcttttaatggatgttgttttgggactatgcaacattgtggtcaatgcttgcatttgggattgagcttcaattgccgtcagatgacccttatttgtcaatttctttgcgtgatttcttggggagaaggtggaacctcattgtaacatataccctgcgtcacaccgtatacaatcccgtgaaatcattattgatgtccaataccatgttgggcccccagtgggcctcggtgtcggcagtcatgatctgctttttacatcatttaaatttctaatacactatttcataacagtggaataccaaaattatctttggcattttctctcatatgaatctacgtaattcatacggattgacaaatccgtaaaaaccttaacttataagatagtgtaaaactgtttaatattattcttatataaacattaaacacttctattattctcaattattctcaattttacttttccaatttcattgtctcgcgcattaatcagagagcatcacggtgcatcatactatacgcatcatattataccccgtattatttgaaaaagacgtatattatttgtttacagtttcttttttaattttatttttcgacaagtaaacgattgttgctcttcttgcacgttttgcacttactaattttgttttatgtatgaatatttatctatatagaaaaacaagtgaaatatagtcactgcattcttttgttcttagtttattaatttctgtcttacctatgtgatttctttttaatctcgtgacgtgcaggaaaactgacaaatggttaaacttttaagttagaggaattatttagtagtttaatattatcataattttaacttgtcctttttatttatttatttattttttggtcgaccaatattaattgttaaatgttaattttttttgttagtgaagagatttcaacccacaacctcttcttcttttccttccttatctttttttccttttaccactcaaccaatcttatatctcctcaaatgttgatgtcctattcctatatcaaaatacaccacacacattttcttcatttctatttctatattagaaatactgatactaatatctgaaattttaccataatcctatagactatccgtgatagtagtttattttggattcgagatttaattattaattgcttgaaatttcagatattgattaaagaatgtttaatataatactgatatattagatatttttcatttttagtataataaatattttttttctagatttgttggcattttaatgataaggaaagttatatattaacatagagtgcagatcttctaaagtaaaatatttgataaagtaattaaattgttggctagtttaatacttaaactataaacttgaccacaccatatccattctttatatatactatatttattccatttttattgaccttattatttctcctattttactattgttattgagcttttgtgattcaacaatcagtatgtgaatcacttgtaatttgctatataatttataaagggtaacgataattgtgaaatatttgtaaagtgtatttttctcttcaacatgaccgtatcttgctgcttaacaataggagaggattcacattcgatgcaagcattaatcaattgcaaaagaaaacctattcacctcgtgctaatttcggttacagtttactaaataaaaggcttcttttttcatttttttttaccatctgtatgtatgttggctcttatggaaaacattataaccggaaataaataaaaaatccatgtgacgtcacataattcatcacgtttcttataattggtaatgaccatgattgcatgaaaaaatcctctcatcaatttttttttttataatatagtaaaaccgagatataattttcttatttcatcaaaatacttatggaacgaacaagggttgaatacaacaattgtaacaacatgggataatgcccgcaatggaagatgatccaattgaaacgtcattatccaacaagaatacatacagatccagccagagaaaatactgaattatttatgagagctgaaattatctcctctccagcgtctaactagtgattcacattcttaagagttgcatctgtttatacagaaagttattcaccctcactcaagataggtactatgagcggtttcatctgtgctagatatacaatcgcccacctgatatagcaaatgaagaacaaaagtaagcaaaaagaaatggaaaataaaacaggacatggctatttaccagttagaattactattgaaccaaaggaaaatgtaatcacaaattaatgaaccaaagttcgtcaactcaaggcaggcatgtttagaactatgaaaattacatcaccaggagaaataaaatgaacttaattgataaagactataaaagattttggtattcccccttttccaaaaaaataaaataaaaataatgtaattcagcaaagcatgtgctcattccatcaaaaggtcattttccctcctcccttaattatgctggacatactgtcagacagcaaataagtagttatatcagagaaatgataacttttcaagcatttgacttcttgattcagaaactactcacaagttttgatgcatttccacttaacatcactacaattatattacagtcaatttaagcatcaagcacaagccaaagcttcccatcatatatcctttggtctccttgtgaaatatggtggtgaacagtcccatcttaggaccaaagtaaagcaccaaaggcatgggtatgcccaggcatgattgcctaaacagattctgattttgaaaagttcatctattcctcttcaattacttttgtttggtactgttacgcaggacacataataattcaactaaaaggtactccaaattcatgtggcagtatcatggtcatggagagtaaaaggacaggtacacaaacagcttcagcagaactgattatggacacattcagccggagaagttattcatttaggaaataaaatgaaaactttgattttagtgtattccttttccaattaattgaataacagcttgctggggcaacaagctcaggaacaaaacttgtacagtgcagcaattccctattctaactccatgaaaattaaaagaacttgcaaatcaaaggtgtacttacatcatccagcagcatgttgtagcagtaagaaccaaagttaggtgaaatctgcaacaaagtaataagatattagttcatacagagaacaataattttgtgagaggaaacattatcatggaaagagatggatgagacacaacaaaattcaaggaagtcattattgaagaatacaaaaaaactttgacacaaactaaaatataaacataaatacatcaatcacatcacattgtaaaactcatcaaggcgacataacagaatcagctattaattaaatagagcagcatatccacaaagatgtttggcaatatcacaattccttcaataacaaatttttccagatctatgagttatgcgagattatgaatttgttatttgtaatctgtgtaagattagcaacagcaattattaaattagttcataagtcccagaaagaaatgaagaagcaagcatagcatacagattagctgaaggtcctctattgaaacaaattctggtacaaagggacgccacgattccaatcactgcgaaaattagcgtggttacagagaaccccataacggatcctaattcctgtgagacacaaacaaaatttgagaacgtgaaagtgaaaacgaaacgacacaacacaacacaacattacatatttttacattaccccttagttccggtaatgcgtcgtcgtattagtgatctgaagcttcttagcaatttggtttgatttgaattttatcacctcgcatggccactgattgattgaacatgattcattatacctgcacgcatatgggcccatcttattccctcctatcctgttatttgggtttcttgggccacgtttatcagcttttgctattaacactccaccatttactattaaatatattctccttttcttaacaaatattgcaaacgcgtggcaaatgaagtacatcgatcatacattcatactcactcttgtatgtacccaaaaaaaagtataacactctcatactacaatgttgcctaaggtggtgctttccaagaaggaagaattgaaattgcacatgaaggtctaaaccaaaacattttccagttaaaaatttaaatttcttgatttaaacttctagatacaaataaatctttaacttactattccaaattttcaagaataaaatctaatgtttcaaaaaaatagtttttactcctacaaaaaattggaagaaagtttttctatctgcatgaatcaaaaaacatctaacttaagtttttaggttttaattttttttattcttaaaaaagattgacatgtattaagaatttacaattcatgaatccttagattctttgattttaaatctcaatttactcttatatattaaaatacagaatttttttataaaatgaaaactttaagtgcattgaatctcaaataagactctgcgtagtttgattttttttattaaaaaaactatatatcaaaaaataatactcagcccgatttattacactagttaagatgttacaatagcatttgacgaaaaaaatgatatgtatgataccaagaacgttaattgacgcattaagagaaaatagattaatagaaatttttaatataaacaattggattcaaattttatatactaataagttttcaataatttcttcaaatactttaaatttgactaaaattttaaaataaaatataaaaataccatcattttaaaacatttaaataaaagaaaatttatagaaaaaatatttcaagacacgtcataacatcaattaaattggtagtgtgtatgtctgtgtttcttttacagcaattaaattgatatagtatgttaataactgatttattagtgattatagattatagatttatttaaattttttttattaatgctttttttactagaattttattattattaatgattaatactctttactttctttcttctttattgtaacatgcgagccaacgagcaagagacaagagtggagcgaaaaacgacgtcgtcgctttccgtaacgatgaactgttaataaacaacgtcccttcatgtgattcgaatccaaccaagtaaacaaaatccactcaaaattggagggtaatcagcttcaatttctttccattttcattttgccctaaaaccctaatttaaaaaaaaaaaaaaaaaaagaccgtgagtgagagagaacaaaaaataaaaatggctatgcttcatcccctcacaaaccgcaacccaaacgagcttctctcactctcatgctcttctatattccaccacaatgcactcacaacttccgtttccttcaactccagaacaacaaaaattgctcctcaatgcctaagtcgtcgtttcgggtcggtgagatgctcctacgcttacgtggataacgccaaaattaaggttgtcggcatcggtggtggcggcaacaatgccgttaatcgcatgatcggaagtggtttgcaggtgggtcaattgggtattgtctttgccacccaatttggaacatcgataattggttattatcaatatcattttttttcaatgctttctatttgtagtgactccaatgctttacttcttgtgtttggaggttataccactttaaaatagttattgttgaagtaaaatagttattagaaattagaatgacagttctatttactcttcttcttttttatcttgattgcacattttagattcacttatttaatccaatgttaatttttagccagcggcgttattctctaagataccatttgtgtttggacaaaacttagatgtaattatttaggagattttgtccagttagaattagagtttcacctcgatagtttgcataataaatgcttatattcgatgtcggcataggttgccaaggtgaaactccaattctgattggagaacaacacaaaagcacctaaataaatgcatctagtttttcgcctttgtgttttgctgccaccaagtgaataatgcagatgttattgttgaattctgcggcattttcttttcaatcagggtgtagacttctatgcgataaatactgatgctcaggcactattaaattctgctgctgagaaccctattaaaattggagaagttctgactcgtggattaggtcaggcactctacttgcatagtttttactatgatgtgatttgtttttgtggctacagtcttgtttctttgctgaatttgttgacaaattgaggggggtggcctttgattcaaattacctgatagacaagcaggtacgggtgggaatccacttttgggggaacaagctgcggaggaatccagagatgctattgctgatgctcttaaaggatcagatttggtatttataacggctgggatgggtgggggaaccgggtctggtgctgccccagttgtagcccaaatatcaaaagaggcaggctacttgactgtaggtgttgttacctatcccttcagttttgaaggacgtaagagatcattgcaggcaggtgtcctttttctcgttatttgggaatgtgactactgaattagttttgctcttaatttaatactaccttctttttttaatatgttgaaaaatatcacttatcttcttcctttgcagtttattttattctggttaaaagtgtgtttggaaattcatcttttgacattgtgttgaaatgaatggattttccaaacacaccatatagtttgttatccaagttatgtgtcatccagtatatataatttgttgtctgaaatttattttatctagcagataagagtctatggttcatctgaaacttgtattttgtcgtttgaaatctagaaaataagtctctagtttgcatttggttttcttcaggcctttgaagccatcgaaaggctgcagaaaaatgttgacacacttatagtgattccaaatgaccgtctgcttgatatagctgatgagcagatgcctcttcaggatgctttccgtcttgctgatgatgttctacggcaaggagtacagggaatatcagacattataacagtgagttgattggcaaactatgtattcatatttttttattcagacactagaacatgatttaagttccttgctgatcccataagatcagctacttgcaaggagaaaagggaaacataaaaagcttgaactattctccccctacttgttccttagtgcttttgagtggtcactggctcacttctccttcataattgggcattgtggctttgcatttatgtctgggtatgtccatgcattttttttctggacattataaactggtgtgccttcttgcaggtacctggacttgtcaatgtggattttgctgatgtaaaagctgtgatgaaagactctgggactgcaatgcttggagtaggtgtttcatcaggtaaaaaccgagcagaagaagcagcagaacaggctactttggctcctttaattggatcatctattcagtcagctactggggtagtgtataatattactggaggaaaggacataaccctgcaggaagtgaacagggtttctcaggtatttaaagattgtcaccacttgcttaagaaacattttgttattcctttgatcttgtgaatttgttgcaaactaaccttataatgtttcttgattttgtgtttatgatttcaagtatagtgctgcagttttttgttatggttatatttttgcattcattttaccttaacatgttaaaaaagttatttattcctctggaattcatctagtcaagaatttcggatagctacccaacctttcactggaagagaaaaaaaaggaaaatatcaatatttccctcaggggtctgtttttcttttcagtttgtgctgtattccgccttttgctgtatggtggtatacgtaccgggttcactcctaccttttcttcgtatttgccttgtccttaacacgtgtaatttttataggtggtgactagtttggctgatccttctgctaatattatatttggggctgttgttgatgatcgctacactggggagattcacgtgactatcattgcaactggcttctcacagtcttttcagaagaagttgctaacagatccaagggctgcaaagctgcttgacaaagtggctgagggccaagaaagcagggccgtccctcctccccccaagtcctcaaacaaggttgaatctagaccatccccacggaagctctttttttagtttcatggttcttttacccttttcatttttccaattattatattgtagtcattctgtagtacaatgatcttgatgcttaatttagtgggatatcattctcttgatgttctttcttcttttcaaatttaaaagcgttagtttgagaatatgttgtgattttattttcacttttaagtacaaaataattaccttattttcattttattttgtttattcaagagtgataggaactgaactagatttaaaagaagaaagaatgaatctttatttgaatattggagaatatatcctgcaatacaatagtgaattcgaggttcaccactctcctaatactttctggattccctttcttcaatcactcacctcctatttatctatttgtgaccctcccacatttagtataactaactaactaaatgtattttactaattgaccctcctgttatacattttgccccacctcctactcctatcagatttgcataacaagttgtaataaaaaacttttttaccattttctagacattctttaaagagtttaatatctatgcaccgaatcaccgtttaaattactttaaaataattattttaaaagttaacaaatttatcatatatgatagattgtgattgaatgattgtgtaaaattttttaccccgtcactatataacccttttttcttatttaaaacatgaaacaaagaaattataatgacatttttgtaattacaaatgaaaggaaaataaaaacaaaatatatccttgaatcgtttttgctagattaagataacaatgaattataaattgaattgaatatgaatatcctcttgttccctcttaccttaggatttcccttcttcccatggaaaaaaacgagggaaggttataattaagtgatattacatcatgatcaagcattgaggaattcttatagttaatgtgtgaagatctgacaatagaatgcatttaaatgtcatctaaggataaagtgataaagttattatttttataagaaaaacgttatattgattctttgaattatcaatgattctttgaatgatcaatgcatttgagaaggataatctagaaaccattacaaataaagttttgaatagctggaaaaaaaatattaaaaacaaaacaaaaaattcaagttaaataataagattaaaggagtagagtaacctgtaggatttatttattgaatttttcgaaattacatcatcaaagaaaaaattgcttaaattgtgtaaaaagaaagggaaaaaatgaaatgttatgatgggatttaagaaatttaacttaagtacctcgttgtggttgcacattaaagtttttattttattttttataactgggttgcacattaaagttgcacgatattaatgcaaatcacgtacataatacttgagcacaatctcacggagaaatgtgtgaaaactcaaccacattgatactccagccagtagcattcactttcatatttgtacaagagaaaaacacacgatatataaaacacctaaatatggcaattacaatacaatacatcgcctttcacgacctcaacaaattccattccattggaaaagtaccaagagaaatcaggaaacctggttatgattctttagtgcacacggcagaaacaaagatgaaaagcagactcttgccaagtttgggtattttattcattacaaatatttgaccaacagccaaatgacaacaaccaaagccactataccaaccactgataaaagcatgcacatgcaggagcaaccacccttggctcgcttatttaaaaccgctaagttcttctgcacccgctgttttcacaacagaaacataaaagataagcagcaagtaaatgtcaataatattaacataatttaaccttgatatgacttaacaagagatttggccccaatgaagtttacgataagagtgttaccctaagccgagaatctgtgacatctacatgttggtctaagtcatcctggcagacaaagacaaaaagaaaagattcagttttagaagggaaacaacaaaccactagctgaggttggctacatagattacacaacatcattcagctcggatcaaaaccaaagattcaggaagaacaaaaattaatgcacaaagggaacatacaattagtctagtgtgtagattcagctcttcattcactgccaatgcaatatgttttgtgcttgccacagtctcttccaattgctcaaagccatcatcttgttctgcttgaatagcaatgcactatcagatccaaagaacagattaaaagcaatatattttcaaacaatccaatcaactgacctttcataatttgccgttgaagtccaacaagtccattgttgtccaggtcaaccgttctggtaattgcatctggttttctttctggcccaaacaaactatccctatttgcaaagtttgacatgttcaacgtggaagccatctgattaacttttgatctcaaatttgaaagcatgtccttgcgacgattcatctccttctcagatctgcgtcaagtcagcaaaatacacttcataaaacaatagtgcaaacttcatcatacaccttcacagctgaattgaaaacattgcctcttctattttaaaccacgtagcttaataaacagcatgacctttttcaatcagcataatcaacaattacacactcacatgggctgcttgctgggaagatttgacaaaagggactgcaagctatcaagcctggtccccaatattgtaatctttctccttatagcagatgaaagacgctgggtttctggtccagatgcaggaaatgaactctgctcagaaatcatgccactgatatcatcagcaagtttcagtgcttcattatattccttcacccatgagtctgaagaagatgccattgacctgaaagaaagaaaaaagtgagagaaaaaaaataaaaacaaacaaatatgatgtttacatcggagaaatgaagaaatagcacaacaattaacaggtggaaaaaacttggatgcggttgtttaggtactttcggtgttattttccaatcataatttaagttttaccatagaaatcataaagcacatgttaccaagctgaaactctaattttaatagaaaaacaccggaagcatctaaagaattgcccggtaataaataaactagaaaggcctagaaatcttcaaaacggtatgggacatgattatcacaagataaattctatttgcttagtacaacccaacccatacacaaatttaccagtacccttgttcaaattaaactacttatctcaacaaagcttttctccatttaaaccagaattgctgttaacagcgagtacgaaaaaggaattgctggtaattactaatttactacaacaattcaagtatgaaagaacagcatgaagaacccttaaaactcatgatcgcacagggtaataataaaccatggagtcatcacgagatgctgatatctttaacatgagctaatttcacaatcagacatacacaaaacgcacaattcaaagaaaagaagaagcagagtgcagttcagaaggagaattgtgttgataaccgaaagtgatcggaattagagtaaagaggggaaacgatcggataagaaattaccctcttttttgggaagctaccactgctgtgactgtgaggaagagaaaaggggtgatggatgcgacgtcgttttaggaaggtgccgatggcgatggatgggatgaggcgtacggcgccacccaccaatcgtcaccgtcgtttacctcacgggattgcggaagatgaaaggtttcgaataattcattcaccacgacgtcgttttaaggtgtcattttcgcgagcattttctctatcttaggaactaggaacacataaaaaaaaaattaaaaataaatgtaactttttctggagttcatgtttgagtgttttatttatttattttggaaatttaaatttaaaaaaaataattttttaagttttagaaaatgaatatttaattttaatttatcacgtttaaatatattttaaatttatgatcataattatgataactacttattcaacatcattatcattatcattatcattccttcacttatttattcatctaactcacttaatatctttttattaattaatatgcatagcagcagtattacgcagaagagaaatgtaaaaaagaaaaagaacagttgtagatttttaggttttacagggtagaatacttttgggacttgggaggcttttgtaagggtggggatctattgatcttgaacacattctatctgtgtcaagtatgtcttctaataaaatgtttagcatttaaaagaaaacaattgttggataatgtatgaatgtattaaaagatgttatgattttaatttgttggttgaattaataatataattgaacttgtcaaattcaaagatatcaccagaaggagtccatattgcaacaagttgatgcatgcacaacaattgagtccccttgacggacaggaagattagttggtttccattccactaagggtaggcaaagttgtccgaaattgtctctcgggcacataccatacccgaagcctccttgttcatcaaagatagatgaatttgaatataagttaaaagtgtttttgagaatttttctactaaaaatataatatctttttcaataaaaaaatctttcaaaagtacttctgatttgtatccaatcaggctcttagttcctcttttgccagagtatgctctcgattttcaactactttcttccgatcatcgcctgtccacaatctgcctcgatcgaggtttccatcacatcctatcttcactgtttttcattccatccttgccagatgctccaaacaatcatcgcaaaatcttcaacctctgatgcttttctagcttcatcattattgagaacgcaccctcatattaacattagtactctgattccttatatccaccaaaattaatcataacattaggtccaaaattccacaaaaatacatgcatcaagaagttcaaattataaattcatcttaatacaaggcaatcaatctcagtttcaaacacatttacaagatttctcttcataaacacaactttaaattattccgcctatgtccaataagtaaaaaaacataataaaaagaaatattattcaatctcatgaataaaacttacaaaaaataaaaatggtcaattacaaatattcaatgatcacttgtctttaaaataaatgttttttaaaataggttactagcactcattaattattttttccctatgataatagtgtaaaatattattgattttgttgatgactatgttatattaataaatcttatttatcacctttattagaacctctttattcaatcacaattttatctacaagacttaaatacattgcttaagtggtacaagttaaattttactcataccaaccacattttagttaatcactatgttctttgataaacaagtgcatgacttagactttttctataaaaaaattcacaagatgataattttgtcagattttctctctctctctctctctctcttaactgtaggctcaaagccaaatttttatcaatttcattattaaaatatcaagtaattaatattgtatttgatatgataaatatgtgaaatacagtaacatcacaaagtaaattttcttaggcatgtttggatgatttttagttattagtttcaatttttttaaaaagaaatgaccaatttttatttttaggttttttcctcaaaatttaaattttaaaataaattcattttgaaagttttatatcctattaatattaatttaagattgattttatgtgataacggtaacattaatgatgataataatagtagcggtggtcatgttgatgtcaatgacaatgatgaagacattgatccatagtaacaataatattagtaatgacgatgacacaacaacactgatggtgatgatggcggcacaatgaaaataatcattatcaaatgtagagaatgtgtgattttttaaaattaaaatccacaaattattttttgttttgttttgaaaataaagatgagtaaagatatcaatttcatttttaccaagcatttttgttttaaaaatcatatttaaaaaccaaaattaaaaaaacacaccacaccgaagagtcttaattatttctgtgattaaatttctgtgtgtaaaccttgacgtcgcatatatattatagactgttaaacgtttaatatttgtaaactttaattgacatgctatttctcaagttcttcaaaattacatgctggtgtctttgcatgccattttcttatttttcttttctttaaagttactactatcaaatacacacacgtgtgtattgagatacgatttcctcaccacttaaaattaccatcaaacacacacacacagagattacacttgttacatatttctaatttcttttgtattttttatatttcttttgtcttttttattgcatcacattaattactcacgtctcttctattttcttctctgaatgcccaagagatgacaccattttctccccatatgtatttgttacttgaactctacggtttgtaccttgtatgcatggaagctaagtagaagaaaggaagagtttctatttggaactatatacacacttggaaagtagttatatttttcttgtgggtgttttctgattttctcattgatgtgcatggtcaagtcattaattagttccgtatggttctttagctaagctgcaacttgagggtttaatctaataaagacttgagcaattttttattaatatataagtacgaatgatatagaacttaagattttagtgtatattttatgatctttttttattactgcaacttaaactattaatcattatttatgttcttcattcaattatcaaaagaaaaattcaatcattgtgtcattatatatgctcgtgtaaaagttgctataaaggttggatatacatttgatagtattgtcattttctttatactaatgcttatacagcgagaagggcatgtcgacagacaaaatacctgtatatagttctattattttagtgagcttattttatttcaatgtattggtaactttgtcttattattttagtgttactcatccataagaaattcaaattttattagactcgatttcaattaatttggtatctttttcaaatcatggatacaagctaagtacaggctatgtaataaggtttgtaattcacttcatctctcatcttattgatttggtttaaataattccaaacaattcggaagtgttttttttttttttttttttttttttttttttttattgacgacttcgtagttgtgatgttaatatttttttaccacatcaattaataatattttccctgattaatagaaaaataatttgagtttaactgtcatgtattatcagtataatttttacactattatataattaataaaaaccaatatattttatttttacactattctataattaaaaaatcaatatatcttttaacgtaattattttaagatcaaacttagcatatataataatacgtaattgaatgacaatttttttacactttcagtgtattataataactgcattcttaatattattgaataatttgtataatcttaatattgtccactaacttttttagactaccaaagtaattcttttagtaatataataataatatgattttaagggataataataatatgattaaaaatctatttgtatgagaattttagtcaatttgttgtcaaattaaataattttattgtgatatatctacatttcttagttttttttattaaaacttcaaataattgtttgatatatcatgttttcaaagtgtgtttgtttgcgcttcctttacatgcctttttcttaatttcacatcaaaatacattaaaaaaaacatgaaaactactatctggggtgactctggtatggatcatatataattgtgataaaaattatggtgattgtgaaacaacattaaattacttcaatttttttacaggtctcatcacgataatggttgttcattgtggttttactatcaaaccaaacaccatttatattaaacatcagacttagacgtacttaagacctactaatgcctaaccaaacactcagctatcaacatttgattcttggttgcattttaaaaattattgacagctgctttttcaatttctagttgcatgtgtgtaaaaagaaatcaagtttttttttttattgtcaattattttgattagaaatacagtttcgaacaatgactttaataacctaaacatttattaattattacatcaaattttataaatattggtttaccttatttcaaatatttatgatttattttaaaaaagatattataaagttatattttttttactgtaatagaaagaaaatattatcgaaatggtgcgatatgactagcgtcattaggaattcaatttcatgttacgaaagaatatttgttaagaaatatagtaaagacactagtcctaattcttggtcataaattgatattttttaagtagagagattaatcttgatttgtggccgagagatatgcaaataaaaacaaaaaaggtagagagggaactaaaaagagtataatatctgatgcagaactctattaaaaaaaaaaagatgaaaagtgagtaatttggaaatatattagaaaataaagagggtgattgcaaaaagggaaaagattgaagcagtagagaagagaagagaggagaggggggagaaggggttgcagagagagagagagatgtcatcttcagacctggacaggcaaatagagcagttgaagaggtgtgagcctcttaaggagtctgaagtgaaggcgctttgccttaaagccatggaaatccttgtcgaagagagcaacgttcagagggtcgacgcccctgtcaccgttcgtcactcttttccctttttcctctttctgggtttcgatttacttatgatttcagctcacgtactaaacaaaattacctcgttggattttagttcaatacgattagttagttgataactactttacttgggacttcaatctatatagggcttgttataaatgtcatatatagtgatgagagaaagcttaagtgtcattctttcgaggggatttggtgttttttgtgtctctttattttgacctatttacataaaaaaaacgttgttttgtgctttgttctgtgtccagagtgtcatgggggcacacaaaaagttttttttttcttttattttttttctattactgtgcatttggggtctactctgctgtgttcattcttctttatgatcctgcttctggtttttgttgtgttcaactgattagttttgttggttgtcttggtctttgtgtagatatgtggtgatattcacggtcagttttatgacatgaaggagcttttcaaagtaggaggggattgccccaaaactaactacttgtttctgggggattttgttgatagagggttttactcggttgaaacgtttctgcttctgctcgctcttaaggtgataatttattcttcttctcttataaaactgcaagttagaagcatcttctgtggtttatgtgtttattttatgcttttttttctgtatgttagatctgttttgggtgccttttgacaatttaaaaaaacgtcccagtcagtttaatctatgattatcacagaaatgtggttggtcttcgatccatgggcttggtggtcactgcatttattgtctttgtgttaactttttaatttttttttcttttttgggaacacattttgctactgttggaatgaaattctacaagttttttctatgggatagtgtgagtaatgtaaggatgctttgttattggtgatgctttattaatctggtctggtactaaggttttgtcagtaaaaagtagaataaaattttgaaatttttgcttttggctgttgtttggtggatttgaatacactgaaatttactcagcagttttgtcctttcaatctcgtcagacatgattttatttgcttgctctagggactcgtttgtttataatatgaaggactactctttccttttgagcttatgttattttgtctatgctgttttctttaatctattttctgagaggatgcactgtcctcattctttctactttgtctcttgatgaattctttttcttatcatttttctaaaggaactaaagaagaaaaacaaaagataattttattttttttacttttgactactaggttctgtcagatgttgaactactcattctttttgtgctcttaatgatgcttctttcattttattcgttattgttgtaactaattaatgacatacaatcaggtgaggtatccggatcggataacactcattaggggaaaccatgaaagccgtcagatcacccaggttagtctatcagctaaattagaaaaaagaaataaatcctttttgtaaacatgatgaagaaaagtgggaaagacactaaaaattttcccaacattttatgactccagattacttattcaatatccatcacttgacaggtatatggattctatgatgaatgccttagaaaatacggttcagtcaatgtctggagatattgtactgaaatattcgactatttaaggtttgctaatatctgatagatcaccagatttgagtattgcattgggagctacttctccttaaggatgctttatgtcgcttgtctttgtttattttgaaagggaaaaaagtttgagagggtgcttttaaaatccattgattggttattttgacaaccttgtctaataaatgtatagactgaaaatgctagcaaatatttaatactcttttctcaaaactctttccattattaagtaaattccgtgtattatataatgggattcaattcaataataaagagagcagtattgtcaatcttacctgtaggatcgtatgatctacttgtgtggctattctgtgctcttgattagatgtagaattgtatgagaatgggattacagtgccaggtcacgagcttgtggaatgatctatcctcaacgagttgcagagtgtgccgtgaaattgtgggttaggttttatgaactggtggggaaaagattatatatttgccctaatctctcccctttttcttcaagtgacactccaatcaagcgatctccctctattcgaacttgtctctgccatctattctctatttcaagctcgttttggcttggcttacctgaaattgagaattttccgtgttttctctttttgtgttcgaccttggtaaccatacttatcttcagtctctgttcttgtttggaacccattttgacttgggttggaatgtttctctgttctgatctttgtagtggctagtgattcagtgttgagtggttctgttctccgcatcttgttagagcatttctgatttcaatctgatcgtcttccctgtccttaattttttggcttataaaagtagtgaattgggcttgagactggcttctaagtccagtacactttctggtcccccctcccccgatatcattatcaaatataaaacgagatgcattattactaataaagcaattactacaaaataaatatccgaattgttatctaagtcttgtggtattattacgcgtcttaattaattacattatcatacttttatatttttggtaggattttttaatcctatacaatcacatggtttatgatctttcatcacttctcgatcctagatagaatctctattttaacaacattcaggagtgttgaaaaaagtgttaaaatgcaagtgtttctcgtgcatagaaatagccaaaaattaagagacaagaggtataaatggaaacattctgtgtcaagttgcttgtaagacaacctaactgcatttacagatttaattggtatagcttgactcttccactaatagtgtcctatgtcgataacggcaaactgcagcttgtccgctctaattgaaaacaagattttcagtgttcatggtggtctttctcctgccatttctacactggatcaggtcaggaaatttaccctaatttgtttgtttttgtttagattgtacactagcaatatttttatattatttattgttaatatttagatacgaactattgatcggaagcaagaagtacctcatgatggtgccatgtgtgacctcctatggtcagatcctgaagatattgtggatggctggggtcttagtccccgcggtgctggttacttatttggtggcagtgttgttacttcctttaaccactccaataacattgactatatatgtcgtgcacatcagttggtaatggaaggatataaatggatgttcaataaccagatagttactgtctggtcagctccaaattattgctacaggtacctaatccactaatctattaaaatgatttttcttatttgtgttctatgtttttagtaagacattttcatctttgtcatagatgtggcaatgtagctgcaattctggagttggatggaaatcttaataagcagttccgggtgtttgaagctgctccacaggtttgtaggcaaagtcacctgatatttattgccattatgaattcgtacgcagagtgagctataccatttttctcaaatagtagcaatacgagcttcaatctctctatctaggtggcttacttggtggtcagctttgacatggtgcacgtggaaccatagaaataatatcctgtttcataatgaacctttcaatggtcacaaactcttggaggatgctattttcttttgctggtcttggttaaggagcctagaggaaggctttgacactcctttccatttttggtctactaatctcagccattgttttctatcttgggggggtttgtctcttgtattttgatctgatctatttggcggcactgagagaacttcgtaggctttttggtcttttaaagccttcaaagttcttttctgatctcgcttttctgtaacttcatcagtaccccttgtactgtgtttatatatatatatatttacttttgctgatcaaaaaaaaaaaaatgtggttaagaatgtgcttttcatgtgaccttgggttcagtactataagaatgtgttttatcccattttgtttacttatcagtttgttttcatttggattgcactatctttgcatgtttaagcaaacaattggtgttccttgttcttcgcgaacatatgatcttggggaaatttaattgtgaaatttgtcaattgattttcagtttttttaattttaatggaatgtaggaatcaagaggaacacctgctaagaaaccagcaccagattactttttatgaagtggatttctttgtttctataatctacatgctcaaattattgtgggagacttgaatcaaggagatgatgatgtctgactcgggaggaatcagtgaaggacaaatcagttctggaggcaggagttctgcatcccatccgtctgcttcaaccatctttagtatcatagcagtattgtgaatttgtatgtgatttgcaatatgttgttattacctttgttcattcaaaagctgtgatggacagagggtttagagggaaaatgacgtttgcatatatgaaaacttgattaggaaggattggattggaatcagggaatattgggaaataactttccaaatatataatctgtggaaaaaacccactggttgagttttgattataaagtttgggccataaaattttgttatcttcaatttatctattacgtgtaaatgtattattgctcaaattttacacctggtggttggtactgaaatattgccatgcctgaatttgaatttgaatttgaaggttcacttgtcaaagaaagggtcctctctctattaaaatttatcggaattgtttctttccatattttataaattttcatgagctttagtgttactaatccacaaaaagaatatgggagcacatcatcaatatttttaattcaagttaattagggtggatgatagatttaaaattaattttgcctatcaaatcttaattaaatttttaatttttaaaattatttttcccttaagttaaacaacttgttttttatttaaattaatttagaaaaaatcttaaaaaatacacaagagaaacatatttttattgtgtgaaagggtagcagtaatttattgagcttttgctgaagtgtaaaatgcttgaagcctgagcagacaagaatgtgtgagaaaacctagaatgcaaagctcatgactatgaaagccaacttaactaaatgatgatttatcccagttcaatcatgcaagaaagtttaactttcattagattacgttgggattggaaatccgagttattgtattttttttagccaaaagtctgagttattaaagtgtgataaaagttgagtaatattttaaaaataaataaaaaattaaaatatgattttggtttatctattttatttaatatgcaattttgatcatatattttaaaatcgagatattaaaattttctattttagaaaatttataattttggtaaaattttcaattttatttatgttttgtttattttattacaattaattgaactataaacttaatatatttatttatggtattgtcaaaaataatttaattaatcaaaatataagaaataaaagaaattaatatagacaaaattgaggatttgttcaaaattataaaatttttaaaatagagaatcaaatgtttatatttaaatataaaaaactaaaaatgcgaatttaataaaagaagaaatccaaaattacatttaagctataaataattcgcgcccctctatatgaggtgcatgtgtattttcaattattggttgttatatcctcttattttatcttgttacggtaagctttaaatctcttttatattttcaagacattaaatgtatttagtttttattcaatacttaccgtataaagtagcatgatgatagagtagaaggatacaacattaatttaaggcaaaaatataaaacattttttatttacttagttgagttgtatgtacttgtacaagagtaaagttaaaccatgtaggttcaagaatgggaatattgtaaaataatgcattttcaaaagttaaaaactagaacatttaaatatatttttgttgttataagttagtggttttttatttttggttctttctatttttttttttaaattttagtttctgcaaattaatatttttttaattatgatctatgtaagatatgttatttatttatagttcatgtaagcatgaatttataggaattataaataaaaaattaaaatcttaaagtgattaaaattaaaaaatgtaaatttataaaaattaaaaatgaaaatagaaatttataaagactaaaaatataaaatgacaacttaaaacttaaattataaaaataaactcataagaaacaaaaataaaaaaaatactaacttacaaaatcaaaaacatatttaagtaaaaatgaaaacttacaggtcgcgtgggtctcgagctcacatgtcgttatattaatcaatgatcactactatgccatctccatgttaatttaataatgatttttttaacaaaaatccaaaaccaaccacttcttgctacgtctccattcacagttgctgttcctggtcgttgtttgcaaaaattcagcttcaatccaatacgatataattcattattccacatataaaatagtaagaaaacttgtataactgtttcccttggtatggtatttcatcatatgggtgtgtttaagttttcatctttcactggataaacatgaagaattaaccatgctctagtcaaaacttgttttgctcaagattcaataacttggtctgcttaaagatattggcttgatccctcacacctgcaaaattgaatggcaccctcaatttgttttcttcttctatcccttctgttcctttcatcctccacaagtggtgatgaagagggtttcatctctgtggtcatatctgataaaggccttgattttgccaaggatattctgatagatcaagctgttgcctctattgttcagtctcagctgccacaaattgagaagactgtgcaagtccctcttgttggaaaagccaaagtggttctttctgacatcactatcaatgatatccaagttaattcttcatctgttaatactggagagacaggcattgctcttgtcgtttcaggtgccacagctgacttgagtttgaagtggaggtactctgttagcagttggttagttccaattggaatttcggacagtggaactgctactgtaaaggtatgaacctagaatgttactttcattttatactgcatactataacttttatctttgagtaaatagtttacatactaatagtgtaaagtgttttataaaatttgttgacttttataataactactttaaaaattatattaaccatgatttctgattggttgattgtaaaaattaaactctttatctttttgtaagttacaccgatttgcttggtggcttataatttgctttgttgcattgtgttttaattaagaaagtttgaccttgaactaaataataaatgttttcctgaatttggttatttttataaaaaattagttagcctggttgtactactatggaagctataaggaggttatggttgaaattgcattttcggcgtcttgcaattggagtaagaccaacttgttaaggcataccaattcagtataattgaaactagggaatggagatattaaaaaagaaagaaaaagatgtggtcttgagatggacaataaaagacatgtatttcagtatctgatagccaaaaccctgagtaatgtacttttgtgcaaatattttttttttatacctgtttagtcaattatattcctcattctatagtgctgtgctatgttggaaggttaatgatttgcaagtgggacttactgtgaatttaaggaaccaagaaggaactcttaagttgattctcctggattctggatgtcatgttagagatttatctataaagttgcatggcggagcagcttggctttaccaagtgtaaggaaccttcttaagccatggtttttgataattaggaattcttacacatgctctatcttagacaattatgttcttttattgctgattaaggcttcacaattccatggggaggcctttggccaacagctatagtcccagatctatgtttcaattttactccaatacttcaatctttagtgtgggacctgaaactgggaggccagataagagtgtttccgttatcttctgcaacaaaaactattctggggaatataaagctatatttctatttttttgcaggctagtagatgcttttgcaggaaatatagcatctgcagttgaagaggcaatttctaagaaaataaatgaggggatatcaactcttgaccttttattgcaatctcttccaaaaacaatcccattggacgaaactgctgctctaaatgtttctttcgtggacaatccagtgctgagtgattctgctattgaattagaaattaatggtttattcacaggaagaaatgaagttttggtacctcaagcttaccgcagaggatcagacctttctgcttcctgtggtgacagttcaccaaagatgataacaatttcattacacgaaagtgttttcaaatccggttccttggtttatttcactgtaagtttctgaagtttttagccttttttttttcattgcttagtccaataaatggagttttctcttttcccccttccacttttcattttaagctatatctgtgatgtataatagcatcatattacttgttgcatttcttccaccgttatatttcaagtgaattgtaatgcattagcttgtttgtttaggctttggcattatctagaatctgcagaagaaacaatttctttgttgttccacagtttgcatgttttcttgcatcatttattcatacatattagtggactgagttctttaatcgtttaggttggtcatggaaccttttgttggaattgctctaaatttggaaaaaagtattacttactgacatcaaatagaccttgtattgcagatgccgattagactttatgtattaattgggctgatgctttatgagaaaaagattaaaatagtagtgctgatgttgattaggctttatgtatttattgggttgctccaattacattttgcacttcaagcttttacgttatcataaactgaaatataattttgatagtttgttgttcttgtgctcaggcagatagtatgcaatggattgttgatgaactccctgatcaggcccttttgaacactgctgaatggaagttccttataccacaattatacaaaaaatatccaaatgacgacatgaatcttaatatctctgtatcttctccaccagatatacaagtgacaaacaaagatatcggtgtcaacattttcatagacataacaattgatgttctggaagatggtgaagtcatacctgttgcatgcatctcggtggtatgctttaataaagtcaatattgaagtagatagtttaaaattttatgaagcttacactgtttaaatagccatccctcataatatactgtgtctgcattctgactaagctatatgaaattcaagctttctaccatttttgtcatcatgttatcgcgcgcgcgcgcacacacacataaccttgtattgatcttctgattaaattttcagatttgcctacttttttttgtccatgcctaagattatactatttcttaaaagttaattattttgtagagtttaaagaggtagccatgacacatgatcattatcttgtttaacaagtccattaatctttgttattggtacaggattttagtgcttcttgtgctgtggaaatcgtaggaaacaatcttgctggttggcttaaattgagaaagttttccacgtacttgaaatggagtaaaatagggaaactgcacatgaatttgattcaggtatattggaataaatgtattcagctttgtattttgatatgaaattgaacaacaaaagccttatcccattagtcagctatatgtattatatgacaccattcggcccagttaaagaccaaaatcttcagagatatcattcgtcatgagatccttttgaacaactttctccaatgtccttcttggtcttctcccctcttcttcataggaataaaaaccatgcaatctactctcctaaccagtgctacttctagtggccttatttgtatggccaaattaccttaactactaattggatgaaatttaacaatacgaacaaataattccttctatttttagggactattctagatcaacccatgagtgttttctgtttcaattagagagaccacagtggtatacaaacttgattcattgtcatgtgaaatgcgaaagtgacacagttgccaaccatttgttaaacatatatgatatattcaaggtgtccggtttatgttttggtctatttccaaaatattacaaatgacaacactgccatagtttgagggaagtggtagacatgcagtatctttttttcctggcaataatttaataagcggataacgtgtaccaaccatcaagaacttttcaacccatttacaacctttagcctttcatatttcactttactgattcattcataaatcaaaattctgcacatggtttagcacatatgtaactccacctcatgtgcacaaccactccatttatattttgacatatatgattgttaaaccttagtgattgtatatcgaggctattatgttgaatcttactctttaactgtgtaaacatttacagtcagtgacatcaaccgtcctcaagaccgttgtcataccatacctaaactcgcagttattgagaggaattccactgccaattcttaatggttttgccattaagagtgctcgtatattgtatgctcccccatggattactgtgtgtagtgatgtttctttctcaggagactactatctcaaacaactaccagcttatgtatcataaacatgctctcagatatctgtctgctttgtgtactaagtggtaataaggtaatgagcaacttatcaagatggctatgaagagtgaatgacatgaacattggtgtagctctggattttacctattgtaaatcatgctgtcctgaagattacatggaaaaactgccaatagtcaaacgtccttattggatttggaatgctctgcaggttctttatttttttaatcagggattggtatttttatatgtaaatttgtgaaaataatatattaacttttgtttggatacatcatacataattaatatttttattttcccaagtattaacaaaaactagttttttaaaataaaaacatttatttcttcactactatccaatgtgcgaaacaactataataacagtaagttggaacatagatacatttttcttttatagaccacgtgtatatttacagaaaacaatcttgttccagcttaataagaaatgcttcttagcatacactttatatttacgatttcatattttgtatggcatcgtagattagatgtcttagcatgtgtgatgtcattgtttgctctggattatctttgatatccaagtgtgtgttaacttagaactccgaaaccttacttttgagtcatgttaaatgcaatctcaaaccagtaagatttttaggtctcaaattctcaaaagaatatacgaataaattttaatttcatctttaaccaactttattagaagtgcattaagaatatctcttttgcctactaattagagatttatcttttttcagaaaatgctagattatatggagatatttgataataaaaaaaatgaatgaacattgagtgcatgaatcatactaacattaccttttaccttatctggaatatctataacttgatttcaatgaaagtaactttaacttgatctcgatcaaagtaacttcagtttaatattaatcaaaatattttcaactcaatgttaatttgagtaatttcattgtccttcgttagaatatttttaacttgtcatcggctagagtattttacatggatggacaaaacaaatcacaaataaatgaattcttttaccacctctaattttgacaaattgagttgtcaagtcaactcgaacgtgtgtccaccttcaactctcgtgataatgtacatgatttagcaagaaaaaggtttatatttggttacataaaaaaaagggggaggtgaatttttaaatttaaggcaaatagagtaggggtagcattaatccacaaggccatgtggaccttttgaccttataggcttttgaccttttaatccattttaatttgtatgaaaaaaaaaaaaagtttattcatttcaatttgtcttcttttacctctatttatcttaattaaattttaataattttcaaaatgaattactattggtgaaaaaaactttatatctcaattgaaattaattgttatataaatctgaaaacaatttatacatttaaaaatattttatatcttaacatttattctatacgaagtaaaatggtaattaacattatattaaatggtgatctggaaagtggaaactcagtgagtcgcgttacgagttgggtggggaggagttaaaatagaggttactattaattagccaaaagcccttttatttttgtattctgtgggcgtctctctctcctcgctagggatcgctctgatcagccatccaaactcaactcgttctctttctttcaacacaaactcactactcactacctaattacttacacgccttcttccatctcatttctcaaacacacacacttacccgccaaaattttaattaacccttccaattcaaacctctttcttttcctttccctctcttcctctctctctctctctctctctagggtttcccctcccatggaggaggccgtctccgatccccagccggagctggagcagcagcctccgcctcttcagaacggggactccgacgagcgctgcgccaagaaacctaaattcgaccatggcgcagaattgaagagagtggcggagattgtgctggttctctccaccatggccacggtgcgcgcggggaggaagccctccgacgccgaggtcgagctcatgagggaggctcgcgccaaactcgccagcctctgccagggtttggctccgaaggatattgtcgccagggaagctattggcaccgtcattgaggatctcggattgaactccaagctcaaggaccagagattagggtttcgaactcccaagatgtccattgccgagaggtattcccatgctaagtggaaggtaaccaaccctctctctctctgctcaattaacactcaccatgcttttgacttgctcattttgttattcagtgaacatatatgtagaattaaaagaaatatcatctcgttaagcgagctgctcaagttaaaatgtgtgtgttggttgttttgaattatttgttatgataggtgcttgaggaatactattatttctatcgtgattgttgtgaatgtgtccgagttaggaaaatgaggatagcagcgtgtttggatatgcatcccgcgcgtgtaatttagaagcaacgacgtgtggcttctacatttttcttcttctcaatattgacctgaaaacgagcgtaacgtgtgtagtcaatgcattaccaaacatgcactaagaatgtagtgttcctagcactacgaaattcacctgattcttatgcaattgttttgtatgtttttttatggaggaaaaaggaatccttggccagattattgtatactaatgagctttatttacttggcttggctaagctagtattggattatttttcggttaattttgtgttgccactcttattgatcataaactaccttctcgagtgggctttttgttgagtttgttggaatgttgaactctgttaattagagaagtattttatttcttcacgcacaagtaagagcattaatttatttataatatgcatgttatgctaagaatgatgctatgccatttcttttggttagttttttctcctttattttctctttatttactatcatttttggttaacagatggaagaagcaaagaaattttctgcaccttctacaccttctacaactcacacctctcagcccttgcaaacaaacattggtggaccagttgacaatcgtgtgccatcacatgttcgaatttttccttctgataaatcaagccacccatcaatcccttctatgggtgcggtagtgtctattcctggccatgtttctgcaggatcttctgcagcattgcagtatcaagtgatcggcaatgaagtaagaccaccagtggtttctggtgtgatgcctggcagtcacttgggcagaaattcatcttccttagcattgcctaaagttgaacacccgcagttcaaagttgatggaggatcaaatgggtctccttacatgctgcaagtccaaggtattgtcctctgaagctcctcactggatccaatttccaaggactggtggagttacatttatgattgatgaatgattgacagtgcaatatgtttacattgaatgatagaatgtgaattgaacacactgatatggattttattttactgtgaagcaataaaacacataacattaaatgaatgttcagaataaaatgctgtaattttatggatgaatacttacaggttttattcaatgttaaccatggagtgatgcgtgatgaattttgaaagttgactgaattggtgtatatctaggcgaattggtctattgtgaggttattgaatagatataatctcctagcagatgttgctcccttttccttgtctttaaagagtctggaattaaactacattcatttgtcatttttctccttcaatctctgttatttgtatgtaactgtcatggaaagctggcattaaggttttaactatctattggcattttcttctctttttttttttttccagctaaaggtggtagtctattctctattgtatctttataatgtgtatgagtgtatcttatgacattttagtcatgaaattggaactggcaactgaatgttagaactttttaactgtagcaaatttatcagcaaaccaacctttggtgaatgctccaacatggtctatacagactcaagctgcttcattagctagaagtgcatcagaaaacaaggtgcctgttcagaattctgtcaaggttgaaggaacacctgatgtaactgtatcaagggcagggccacaattaacaacagacccgagctttagaccatttatcactcaaacagccactggaactttacctagtgtgcaccagccattgcaggccacaaacatagttcagcctcctttgattcctagtcatactgacattgctaagattgttcagaaagtgttacaaccaaagcttcctgtccatcccacgtggactcctccatcaagggattatatgaataaggctttcacatgtcagatgtgtgagctcagtgtcaatgaggttgatactgtacttctctgtgatgcttgtgaaaagggatttcacttgaagtgcctgcagccatcagtcttgagaggaattcataatagagttgattggcactgtatgaggtgcttgagtttaagtgggggaaagcctttgcctccaaaatatggtcgtgtcatgagatcctcaaacacatctccaaaattgccttctaatacaggaggcattcaaccctgctctgagaagaaagtagagaatgtagatccaaaggccatcccacagacgttagcaacaaatgggagctctgttcaaactgtttgcggtggcaattacaatgttgagttgtcatctgaatcaaagataccagataccaaagatatgcaagggactgacatttcatccaccattgaagctattgataagaagcctgatccaaacaactctatgaaatctcttagtgcagcttctagtccttccccttgtttgataggtgaaaattatgttcaacaaataaattctaaggttttgactggtaaagagacttcggtatctgagtcttttcctaaattatctgagccagctaaatgtgaaaatttgcaatcatcacaagattttcaagttgaacatacaatgtcacaagacaatgctcaagtatcatcagataagcatgttgacagtaatattatgaataataaacagaaggaatttcgtggaggagaaagtttaacttatgatattaagcgtgatgaccaagatgctgcacttgcaaattttgttggaacttctggaactaatactgatggtagacagcactctgcattatcttcagatagttcacatgcggtagaatggattggtgatgtagtacaactagtagatgagaaaaagtattaccaatcttgttgtattgatggagtaacatatggactgcagggttatgctcttttccccaccagccatgggaaactaactccttctaaactccaggcaagcaaatcatcatgctttccaatatagtctagccgtcggttatgtcatacctgtagaaatttatctgaaaaattgtgaagtagatatgaataacaaaaaagttgtttttggtgtactttactgcttctgttttgttttgattgatttgaacccttgtgtggaatgttacttttataaatttatagaacttttaacatagggatttattccatttttattttcagtctatgtgggaagattgcaaaactgggttaaagtgggttaaggtgacaaactgctactttcctgatgatttgccagggaatattggtcatccgtgtatatctgaagtcaacgaggtatttttttttttattacatacagctttatatataaaattataaaaaatagatgtcttttttattagatggatataaatacattcatgcaagtgtggaagtttgtcattggtatgttaactatcagtttttatctaaagctagattggcttacatgcacttatactccataaactgtttattggtttgaacttgtaacctatacagttaatttctattttgtttgatattccaatcaaatgataatgcttcacatcttggacatgctcaccattcagaaccatatatatggatattttcttatacatatgttttctttgttgaaggtttatgaatctaatagtgatagaactgaaatggctaactctattcgagggccatgtgaagtcctctcatctgataaatttaaacaagaaaatgacaggcgatgtcagttaggaattgaggaaacttctaaagtgcagcccattttcctttgcaggtttgtttctttatattcatccatcattctagagagtttttattttgttttgtttttcttcgtgcctgtttcattcaatttatagttttatacaattttcgtatttgtaatgcagccatcaagtagaaaatatgattacaatttatcgcatggtattcttggtagaaaacagggagatgaaacaaatagctgagtatgaaaagggagataaaatgcttttaattatcgtttaggcttgtcattggtggtggaaaattggagattgaaacatattttcatgctgcttgccaatatgactgagcattaagaatatatcatgcttttctattttgatttcaatttgatgaaattttggttcaaaagggaaaaactccgtaatttttagataattaccttaccaggaaaataatgaatacaagaaagcttaattgtcaattgaacctggcagacaatcacaaacaaggactttcatgtatatgatgaaggaaactcccttcattctcacgcaaacccttgtaatcaatcttgcgaccaaccccagatacgctatagtgggtaggatagcacattctggaagccaaagactgaaatgaaagggcaaagaaagaatagcaggccgaactataattgcagtcaccgcagaagagttgtccctgctgagtgagggtggggggcaagagaaaagagaaaatgacgtctttatagaagaggagggtgttagtgtcattgctgttgaattgttttttttttttttttgggggggggggggtgggtgttagtttatgtatgacaagggtaattgccatttgcacccttaaccctactcccctaaacaacactactgcaggggcaaaattgggttttgaaacacatcacaattgtgctttaattgcacgtgagaatcttgcaatttggttgtgacagatttgacccccaaaatgccacgcaaggatgtggctgtagtgcccagcggctgctctgcggtgctatggtgtcgtattaattaccttggaaacaggcggaatgtggggaagaaagaagagcagtctgcactgtatttgcagtcgctcggagaagaggtcatctctggtgtgggtgggtgggcaagagaagaggatgtcttttgacaagagaaagaaagaggatggtgttggtgcgttgctgctggggggtagttttttgtttttgttttatgcatgaccagagtaaatgtcattttcacccttaacccaccctcctcctaaacaacactactgcaggagcaaaattgggtttttgaagcccataacaatcgtgctctgattatgcgtgaaaaggttgtgatttggctgtgaccccaaaaatgccatacaacaatgtggccagcgttatcaattgcggattgtggaaaatggcggaaagctaataatctgctatatcatttagcggatagtgtcacaggcaaataacaaaagtcacagtggttgaattatgatatatgcataaaaataagttgcatgcaaataaaaaatatgcctaaaattgacatattataaattcaaaagttcaattggctggagactcaccgaagatgactagaggatacagggttcatgcctcaaccacaactcccatagctgccgcaatagtggatggagtcatgattgtggatccaaagaattccataacgcaaaagcactatagtgctgctgtagtggctatttaacaacactggatgtggctgtaatgcccagtggccattctgctgctattgcactattaattaccttggtaacggcctcttttgataacaacattggttaacctactcatctcggaaaacattacagggctaacaagaccaacataatccatgagtctaatctgagtactttacttcaactggccattaacaaaaagagatacatatgggctaacccaatagatacttcgccatatttggcattcagttagtccaagttttaccaaatacgtggctttgctagtctatttatttatgttctgatgaagttatttcataagcttggaatgcaaataaatgctattctatttcattgctgtttctttgtttcttgcatcattttgtgttttatatgcttaactactggttttgaaatcaaatattgaattcatcgtttaaaggttcataccttcactatccgactaccagtgtagctattataatctactggtatatccacactattattaatcaatctggacaaagtctgaataaatcagagttgatattttggccttttcaatttttcttctttttgtattgacttttgaggtgtctcaagtgatttgacttgttttgcaggtggttttatgatgaattcaagaagttatttcaacctgtaatcagttgattatgtcttgaacgtatatgttttgtgattcttacatggtgcaattttcgtggtgagtatttgacccattacctgtccaaattgtcggctgaaacttatttttacccaatgtatctactgaatatttctatccccttagagcacttgtgcgccttagtaaaatcgtgggaacattgggttgggggttatattcctgaatttgggttgaatttatttctgaagcttagacttgtaaacctgctagtttctactatttcaaaaataataataaaatttatagaatccaaacatgacaatgtgataatcacattcttcatctctatgataaagcaattaaattggaacaacaaacaagggaaaaataattggaaatttgggataacaaattaacaatcatgacaaacaaataggactttcaagtcatttcaagcaaaaattagcctactactgtcttaaaggttttgaacttaacattgaggatattttttaagagaagatacctgaattgaatagaagtgaattcaagcttggaaccgagcaagaacagatgaatatagaggaagcaacaaacatgagcccttttagcttcatggacattaagttgtgaatctacttttcatttatatatttccttcttttctcttatttgcatccacccctaattagtgataaagcctgaaacaatagttaactaggtaaattgaagaatgcataacattttggtgttatagataaacttggacgatgcagttttataatatctggttaccttttttgcctgaaatatgatgcatccacacttaaaccttaataattttgaagacatacatgaagggatgttaaaagcggtatttggtgggtcttgattctctccgtcccagttcctgtgctgatctttgatgtgcttctgtttggatgcaggtatttggtggggtttcgaacaggatatttattgtatgggtaattgagcatgcattaagattcatttgagacccattataaggcacattgcagcaacattgcctcctcgtacaagaatgttctatcatttcagcataaattgcttttgatgtaaaatatgtagctgaatctgtggactgcttagtttagctttcgctttggtagttctttttccgatagatattcattctgtataattcttttttgggcattaggctctttaggcccaataattacattattatctttgaattagatcagtgtagttcccttagtttgctgaattgtaagatacttcatttgtacaaaagccatttcttctaaaatgcataaccttggcaatttcgttatcaatttggcgacacgtgatgatttttctagctatcgccaaggtgtttctagattctgctggctgagctttagtattgggtcatgggttgtttacgggaggtgttttaataaaatatgttcaaatcgtccacttaataataaaatgatattgattgagtcacgtatattcacttctcttttcagacatgaaactactttcttaatgctgaattttgggtgaagaatttgaatcctgctaacttcgcgtccatcattagtcatgaaaaaactcttgcagtggtcgatctcgagattcatttcatttgcactttgtattgtgtgtaatgcaacagggagtttttgtacgacttgacggtacgactactaaatactaatagtattaaacattgttttatcagtcgcatcatcttcgtaaagtaatactcttaactttctcaataaaaaaattctaactcagctctagaattggtttttcgaatgaaagacatgtcttaaattgttcattttggataagattggacaaattacattaggtactatttttttcaaagaaacatactgactggctttgtttatcacatattgttatattagagatatttttatttcattatttgtcacactcttcaataattgtagatgtctatttttatacttaaataaattatactgggtgaatagtatgagttaaatattatactttaattttaacatgtatcagtattagttttattgtggttttatatatttcaaatatattattagtaaatattactcaattgttcattttcattaaataaaaataataacatttaagataaaattgaggcgttagttgaataaaaaaataaaattctaagtaaaatttttcatactctttaacaattatctaacctattttcgtaattgaataaatcacattggtgaatagttcagattagataatacggttgatatattgatcctgtaatgattggcatatttcaaacgtattttaaataaaaattgtccaataattcatcgataaacgtgcaaaataaagacactcaaactttttgtattcctcttgcatcatgcaggtaaaaaaactagttgtgtaaggcgacagggtgtttttgtacaacttgacagtacgactactaaatactaatagtattaaacattgttttatcagtcacttcatctttttacagtaatacttttaaactttcttgaataaaataaaaaatctagctcagctccagaattagtttttcgaatgaaaaacattggtgaaaattatgatgaaaaggtggggggatgcgaatatcaaacagggggtgttgggccatgttctttctgctgaggtttgattcacaaggcccaacaaagatctcttcatgggattcatttgctattacaaatagtacagtataaaatgtgtgtgtggggggggggggggggacgggtattacattttcataaaatattgtttatctcccgcttgatgttcacgaattttaatagggttccgcctatttaatctttatcaagagaaaaatatgacaaatttccatataaaatttttaactaatctttttttttatctaccactctaaaaaagcgttgttagtagtacagtattttcttttatcgatccctataagtagcatccctatctccatttattgatgcgtatttggtggcctaagtttgtgagtatagacaaatagttaacgccttaacggaaatagagacaaaggaattgaagtagcttcgtgatatcaagacgttgactaaagtcttacattggaaaagataaaccatttgcatgagcatcgtgtttgtgaccatttttttttgggtttaaaattaactacatagacataggagtatgattaatctagattgagtcaagtgggactatcatcgcagacgaaaaaaaaattcccctcgaatttaactcgagacgtactccttgattaagttagaaccgagatatatgtatgattagcagcaaagttgcaagtcctgagtttcatgtacatctccttctttcccaatatcattgaattcgagataccatgccgggtcctatatcatggaagaacttcaaattatacactgagttctgaatagcctatcaattttatataactgatatataggcatgtggatgcttacctcaattctggcaattcttcaaagtttagactcgatcgcttaattggagatgaaattctacgctgttagccaatcagcatggcttgatatagaaaaatcaatgcaataaatgtggatatgtagagatatactcctatgtacctaataaatgcccttttgtgaaaggaaaaaaaaaatcatattttacgctcttctttgtcgagacaaaccgctcttaaggtgtattttttgcctgaaaagtttgataccaataactgctatccttgaataattctgggggttgctcctttctagagtgacagatcaatatattttagattagtgttcctttagaatttgcgtgggcataaagctagatgcctataggctagatagagaatatataggaaagacaagttttatttataaattaaaattatatcctagttaaaatttaaaaatatttattatgaatgttataagagaatataaaaaaagttatgtataacacaattttatgtattttaataatttttttttaattttttaatcagtggacattgattaatatttgtcaaatgaaaatgagatataatatatatatatatatatatataacaatttttacaccaatttatacataattttatgtttttatctttctctaacatatattatatttcaaaattttctttttcttctcacttttctttttgtaagatttttttttacaaatgtataatttctcaatcaaaattccacaattttttaatatttttttacagataaaattgatgtgaaaaaagagagtcgtgggatgtaataaaaaagagaatactccacgtatacaaattataaccgctgcaagagattatcataactatgtgacatttaaaagaataaattattaaattaatatgccacgtatacatattttaaaggaccaatttaatgtatttatatgataaattctcagagctactagtacgcaagatcaaaagcacacaagctattctattggatttgaaaaattatttatagtaacctaagtcttaagacatataaagagaaagagagggaagtacaagtatgaatataataggttatatgatctgatataaaaggagagatgaagagaaaaaaaaggtattaataaagtgtttgatatatatatatatatatatattaattatattattactcattggatttggacctcaaaagttctccgagcatgtgcttttctacgtaacatgttttctccttttatctttcgtagtggtagtagacaaaaatgatgaaattcatagtggacaaaggaagctagaagaatttgttcataattttagatcaagttgtggttctagctagttaataggtaattaattaaccgtagtggttttgaactaaaataatatgcgcgtagctaaatttacacaaagacattaacgtaccacagaaactaatcttcacttgcaaaaccaaaatatattcctttaaaattatacaaccacactgttgggagaaaagatcttaagctagtaacaaagcacaaattaacatcaaaacacgagtaagcattctcattaaaacttttattctactttattataaggcctcatgcatccacctgtctcaaaagtccaaatctgatgttttgaaccagaagggccacacacaagaaaaactaggcaacgaaccgttgcacaagcatatatgcaaaagggaaataactactaacttacttttgaccatcccaccgtatctttgacatctctcttagggctaaaagtctcccattctctttggttgaatgacctagcttattaagttactaaaggtagcctacacaaacgtaattattttggtttcaccaaaaatatgagtagtgataattcctaatccactaatctaaatagatgttgaataaaaagaataatgaatgcgaaaaggataaattataaatatagttcttgtatttgacattatttgttttaatctctatatgaaaaaaaatctatattttgatattcatatgaaaaattatttatatacaaagtaatatctaatgtttattaaagttataactttgttagaaattcctacattttttatcttgaattgagacatgtcatacatgcaagcacacatatgtcaagtttttttttcatgtagaaactaaaacaaaataaatgatgtagagtagggactaaaatataaattttttcatataggatttttttttaatgtagagaataaaataaaaaatagtatcaaatatagggatcaaatctataccattataactttggcaaataatatataggtatcaattcatatgaattaatgtttttctatataaatatgaaaatgtataatttcttctataggaattaaattaaagtattacatgtaaaaaaactaaaacttcaatttatccaaatgaatatgaaccaattgattttaattaagttttagggtgtgtttgaattggcgtgagttatgtccaacactactgatcctttgtgagagagtatatatcagtgctccctgttgaacatgtatcaaaatgcgggattaaggtaaaacaaacccacaattaagagatataagtagatgctagattattataatgttcatacaatgacaattaaaatatgcaggagataatcaaatatgctaaatataatataaaatgtataaagtggtcggcattgtttcacgtaaatggcgactatcacggtggtttggatttggactttgaagaaggagctcaaaaagaaggagggggccattagctagccagatgacaaagattccaagtttttggattccagtgtaaattaaatttcagaggatagaattaagtgtcatattatatatgatgcctttttcacaaccttttggggcgtgttatgcaaggctctatttctatgtcttgtgtgtgctttttagtaggaattgaaaatatatatcagagaatttataattgagttatattctcgagatatatatatatagacgcacaaagaaaaatagattgagagaatcaaaatcacatcatttatttgcgccgttcagatttgaactgtggaagttaatcctctcttttcttgttcttaaatataatatagttttgtgtcaaaccctacgaaactgttaaaataagtatacattgtgggccaatatataactgatacagttagttaattacaatttttaggtatcatttaaaattcagattgcgtaattttacatgcacttctaggatcattcaacctagatatgaaattaagcctcagagcatactcctatatatatagtccaaaaattaatgaaattataaaaacaaagttcttacgtttccttgcattagatggaattgtacacggaggaaaaactttcaaaaaccagttgatggcaatgcctgtattttttcttttaatttttgtgacgaattataatatagtggtagtgaaaaatacagataaatttctcaaacctagctatatgacatctctgaagccccacccccactctcgatcggtctctttatatatttcgtaatctacgattttgactcctataatgaagaatccgaggatagatatgcatggccttttcaacagttttttttttttttttacttatttatttaattttcttatatatgtggtgaaattacgtttcttaattacaactttaattttaacttaatataaaaaaaagtgtaacttttaagaagattattataatttttattttactcacgacttaataagcttttttattttattttataaaaatggttttgataaagtcataattaaacactaaacacaacttatatgaaaacattgatgtgatctactcacaactttttaatgcaattttttttatgataaatggagaagccatggatcaaagacaaacgttacccctagctaattaattcatgatttgaccatgatttcattatcacaacttaattcgtggttaggcaccatgattttcatttaaattaatttgttgcctatcgcatgagtttcccttgaccgcttggtataaaaatgaaatcatgcatggtaatggagttgtggctaaaaacaccgttaacccttaaatttatataaagaaagtaatggttcgatgaatttattttaaaagaatcgtttactaaattgtaggtatataagtaatatattgcatattggtaaaataaatttaaattccaccaaattctctaaaaaagataaaaaaaaattatggcataggtgtgacaactaaacataattaaggggttccttttgaacgacattcaggattctgtatacctgttgagacatatatgtgtgctgtccaagctgagaaagaatattactgcatcatccttcttgttgacatatctatctcttcatattagctagctaggttctgttattgatcagttttatattaactttgacaattttttattttattttgtttcactaaatgtcttatagttttattcgattattttcatattttttgaagtttgagatggtatgtgtacatgcatgtacttatatagtaaatatttttttagctatatcaatatatcaacatcacttttaacttaagttaattgatattgatgatagataataaatttatttgtataatataaagttgataataaccttttaaatatttaaatgtaagactatgtatttggatattttttctaatcacatttttctcattcacaaaattcaaatttaaaattttactttagagaattcagttcaatgttacttaaactaatgacatattggtatgagactataatttaatttattgctttatatatgtatgagccaagtatttttttaactaatatttgaagtctaattttttcaaagataaaagttaaaatgaataatttgtgcaactgtcattcaattactaattattatatgtgataagtttattttttttaaaatcttaatagtcatactaataataatttatgtttggttgatctacaatgtagtgtaaaattcttgctgatattatataaaaattaaattctaaagattagcaaactaattttatctctctcaataaaatattttatacttactaaaaccaaagtgcaagtatttttttttaaattcacaaaaatattaaaagtggaagactggtcaataatatatatgtttaaggtattaaattatgtctgtgaatattatgttagacttattaacaatatgattaatcgatgtttctttatcgtgctattttttaggaaaaactaaataaagcagtaactaattaataaacaaaagaaagcgataaaaactcaattgattaatctttctaaaaccaggtcatgaagctgaagaatttgtcatttattttaacatatatggaaatccatttgcaatttgaacactttttaccctttcttttgaccgataaaactctagaacgattacttctctcaactgtttttgaacgtcttcattatacgagagaacacggtttcatattaagatgtaaatgaacttaattgaccatatgtaaaaaaagaattaacaatatatgacatgcaatgcatgctattgctgaattaatttgtagttgtgaagcaactgaatttttggggcatctgccttggagtaaatgtttatggtagcttgaagttgattataacttaattgattaccttttacatcccagaaaagaaataccattccatttaatgaattcgttttggtaggtactaactgatgaaccttgatttctggggtgatgacttaattaataatgaaataattaatcatcatttggcttttaatggattactttgactctccttatattataataaagccctaaacagccgacaaaagtaatcaatctcctcacaagaataaaatttataaaaaattgtaaaagttgcttagtaaagagtaatcaatttaagttgctatttacatggcaaactttgggcaaatgaaaggaaacttacgtagccttaggaaccattattatcaccttctttgtttttcaccatataggtagctagttaattgattccttaaaatacgtatcattactcaataatctaacattatattttaatctaaactgcttaattagctgtatcattatgcatcgagaaatgtttttttatatatatatagagtgaaaaaggccatgatggaaaactttgcatagcacttactgtcttatgatttagtacttttttttgcagataatataaccgatatggcattctgatatcaaatatatagggattaattaatgcaataagatatctgtatcatttatacacactataataaactttaattcagaatatagatcgtctgctcacagtaaacttcatagctcataaactttagtgtttgtgtgtgattaagatccttctacctatttaataaaataatccttctaccattaaaaatagctatagatgatcgaaacattaatcttttgtcgaatcttaggacatattctctataacagaattggtataattagttgttacaacaagcgaatacaatattatttctctaacaaaatatatactgtttttttggttttagtcagaaacaaaatcgatatttctatgtagcttatatgaatacaaagatccggcgccagtttgggccttccatgttgcacacgaggcccacactttagcttttaacttttttttcaagtttctttttagtatcattatttttcttttcccattgtgtagtatagttatctattttttttttttatataatgataacaacaacaaaaataataatgcccggttgcttaacataatacatagaagaaaaaaaagaaaaaagtagctagctagcccccccttctctgtctatatatatcacctctagcctcttgagttttccaaactctcaaacctccaaatactctttctcttgtctttatttttcatatacaacaatttccctttcattcattcattcatccatctcacagctattggggatcatatatatatatatatatatatatatggctccaatgggagacaatgttgttgtatccaatatggaactggagaagttgcttagcatgaaaggaggtaaaggagaagccagctatgccaacaattcccaagcacaggtaccatatatatatatatatatatatatatatatatatatatatatatatcatatgtttgttggttacaaaaactaattttttttatttatctgacaaacgctacgtcttaatttactaagaaaaactaaattcagtagataaaacatgcatatgtgatatttttccttaatgatcgaatccaccttatatattgcaggccatacatgcgaggtccatgcttcatcttctgagagagacactagacagagttgaggttgttgagggacgtgaggtggcatttgtggtggcggacttggggtgttcgtgtgggagcaacaccataaacgtggtggatgtgataataaagcacatgatgaaaaggtacgaggcattggggtggcagccaccagagttctcggctttcttctcagaccttcccagcaatgacttcaacacgctcttccacctccttcctccgctcgccaactacgccgttagcatggaggaatgcctcgctgccaacaaccaccgctcctacttcgccgccggagttcctggttccttctaccggaggctttttccggcaaggtccgttgatgtttttcactcagccttctctttgcactggctatctcaggtaaccaacacttaatttattagtacatactattttaggatttttttttttcaagaaataagttataatgtatttttcataaaataaaagtaaaaataatatctctcttcttattagaatatattacactgatcatgatatcccctcttatttcttccaaattcacaagatacttcttttgtctttaatttttccagggttacgtacctttattatttatttaaaatatattacactatcatttttgttatactaaagaaaacacattataccattgatatatatatcctgtaacttgtaagggggttatgtaaaatttaaaagacagggtagtatttcaaagaatggtgtaatttactcttatctctttttatacttttttttaattgttaatatcaactctgacttttggtttgtgattttgttttttcatgttttcaataaacagttgtcaaattgtcacttcatttaaattttctttcttatttttaaatatttttattttgtatagagaataacaaacataataaaattgtcttgtataaatacttaaaattaaaaataaagtgatattttatgtgattgtttctaaaaataaaaattctcaagttaaagaattaattattttacgcagttttttttttcttttttgtgtgtgatggggagggggagtaagttcaatagataacttcatttttacttctacaattttcattaattcgtttatttctctttgcaattgaagtggccggttaaattattacgaaaagtcataatttatttcaaatcatttatgtgtatctttcatcatttgtttgcccaagatctttataaacctttcgattagaagtccaactttaaggtaccacacatttcttggagacttttggtggatcacgattacactaatttcataaatcctttaaagcaattcttgttaacaagatattgccatagtcgtttaatttactccccaacctacccatcaataatcaaagattctctattcctgcagtttttgtcgtctaatctgttatttccacgacaaaatgaaaggaatatttgcctcttcccgaggataagatagtaaagccatcattaatttgaagcttaagtcataatttatggtcaaaaagtgaatgcagaaaacccaaggtctatagggttgaaaaaaggaccatgtttcagggaaacaagtaacgtgtttggacagtaattttcaatgcatgcattaagcacccaatgttcttctactttcatgcatcttaaatttcaataatatatggggccagcacaaagaatttgatcaccaaaagagacacaattggagttgggattccccctgtaaaagtgtgtactatttggtgcttattggtcacacacatttacataacatgttctttatcatacaaaattctgatttcttgcagtaaaagtgtgcagtgttttctaccctaaaggagaattgcattaaccaacatggtgtgacatagttaaaagataattttatctcttatacatatatatagttaggacttgatcacatgccaatgcatataaaaaaatatcttagaaagagattgactccttaaacatatatgaatagtttgggaaattagttatggacttcccgaccaagagatagtctgataccccaacttcataaaataaaataaaataaaaaaaaaaaaaaagcagaaatgcatggatttgaatttgctaaggtgaatgttagttaattggatgtgaccaattaatagtagcttattgttacattaataatgataactttatcattcataaagatcttactcgatttgagcataattagcatagtctttaaaaaaaaatatagtgcatatttttctcttcgttttgtttcaataatttactttggtgcaggtgccagaaagtgtagtggacaagaggtcaagtgcatataacaaaggaagggtgtttatccatggggctggtgagagcacagcaaatgcctacaagaaacaattccaaacagacttggcaggctttctgagggcaaggtcagtggagatgaagagagaggggtccatgttcttagtttgcttggccagaacttcagtggaccccacagaccaaggtggggctggccttctttttgggacccattttcaggatgcttgggatgatcttgtccaagaggtaattatcataatcacaaacatttttatgcatgcttgcttgtgtcaacagtggcacatagcctctatttcccattggctgaccaaaaagaagtttgagacactgtagagattaaaagacaaatatgctcaagtgttgtaggcatcaccccaacttatcatgagttttctctggccacgtttaaaataaattggtcccagccgttgattagccacccctatattgatctagccgtccatttcttgatcatcatgtcggcataaatgataattaatttccggctggctgtgtcttgtggtccataatgttgaccaacaattaggctttggatatcttaagagcttagaacaaacactgaatcacatcgatcatcatgtcttaaagctatagacaaaatggatatgcattcatctgatcaattttcatacaaagatcattgccaatgggacacaacaatgtctttgaacacagtcaaaggcatgtacttataagaaacatcctctaccatgttacacatccaaattccaaaactgtaatcaatgaagtacagaatataacgacaccaacatagtaggatgtgttgagtactttagaacattttcagttactcaaacatatgtcatggtaaatctcacttaccaacttaacactatagatataaggataatttcacattatagttgagtatatatacattattaatagaatggtagatctaaattgtcatatattactgatgttagaatttatttttttgttaccttttcaaaagcagaagtcttgatttaatttcaagaccaattcactatctatccttttatgaattgatatgaacatgttattttatagtaaatcatattcttgatttcagggattgattagccaagaaaaacgagacaattttaacattccagtctatgcagcaagcctgcaagacttcaaggaggtggttgaggctaatggttcatttgccatagacaagcttgaggtattcaaaggaggaagtccacttgtggtgaaccaaccagatgatgcaagtgaagtaggaagggctctagccaacagctgcaggactgtgtctggagtccttgttgatgcccacattggtgacaaactaagtgaggaactttttctaagagtggaacgtcgagccactagtcatgccaaagaactattagagcaactacaattctttcacatagttgcatccctttcttttgctcaaatgattagagactgagagaaaaagggtcacttgaagataactagacgacaaagactttttctccacaccctccccccccccccccccccctctctcccctactctttgtgtgttgtgttattgcataggaggagtcagaaagagaaaagagaggttgaaaacacttccaacctactgttttttctccctcttttgcgtgttgtttgtgtgtcatattgctgactctagttacttgctgcgcattatgcgctttctgacttgtgttcccttggatcgatctgaactaattttgctctctacatagcatacatattatagtgtccatatcttgtgagagtcgtatgaatggaacttgtaccttacaagctgggttgttagatagaccacttgatttagtcacagtttgctttcttccttgtcctcatcaatctaacacttttttttaatatttcattagcaaatctaattggtagataaatgattaattctgttctgttataatttaaaggttgaaagatggctttttctggcttgtcctataacatttttaatagtagttggatgctaccattatattgtgccatgccaaccatgcattgttaaatctgctgaccaagaaccaaacctgatatacatatttagttagtaggaacaaagggaaaacttccccaaagaaatgagtaatgcagagaagaaggaaaaggaatcctattaaaacaaacagaaaacagctgggaagggggaaaaaaaacagaataggatattatcagcggatgaaaagtgttctaagcaactgatattgaaaccagtggcggatctaccttcaaggttgggggggcagtgccccccccttaaattttcaggataaaaattaccaatatgccttatatacatgctaatggaagtgctcaaaaactgagacaaagaagacaagaaccagggagagtgcagagtgccatagttgatgatggaaacaaggaaatcatcctcgtaactgtagtgattattttctcttaatatgcccatttattgggttcggtttgaaaatgggccacaatgcagctgacataaaagttaaatggtatgataaaagttgagttcagtttgaattaataataagtttctaaaattataagtagtttattaataatttaagtacaaaattaaaagaaaaggagcttttgaaaaagctacaaggaggaacttattttcagcttaggtgaagcttttttacaaaataattctttgattctagcaaataacattcatctttctatttatttttcttttattgaaacctatggccatttatctttccatttcatcacaaaatctgcttagcttatttttcttttgctagccttttacatttgttatatttccttctgttttaatataagacactttcaacgtaatcacaaaaactaataaaagtaggtaattcaaatgtttttaatgattttattctgaaacgaggaaatcatcctcgtaaatggcattgtcactccatcatgactagagagtattttggaccagattgaggatttgcagatggtgtaattgttaaagaggtcagtgaaaaaacttttcgtatatgcaaggagttgatagatggtgttattcttgtaagtcgtgattcaatttatacgtcaataaaagtaagattttattttgcttgtaaagtttgtattctaaatctctgatgctatatatatttttcatgtttatatttataactttatatatatacttctctactctctagtatcttctgtgaatgttagaaaatttattgtttgttcctttggattatggtttataattatttgttcttttaattattgtttacaataaaaaaaaaattcaggagcgttatccccgaacccctgccactaagtatgtggatgtcactggtgcccccttgattatttttctggatccgccactgattgaaaccaccttaaaatgaaaccaacatggaagcaagaaattctcaaacaccaatatacatattatctgacagtttagaaccttacaaatagtcacgatcacattgtaggtggatcactaactcggattcttagctatgtctgagattttgatccattattcttgcactccaaatctctagcacatactttccaaaaacgataggagagacacatcattctagtaaactcacaattcacattaaacagattgaggatagaaactaattaatgcactaacactcattaaaatccatctttaatggatacaaaaatgatagtctccgacacttctggcagtctaaagctcacccttttcttcaccttactactttggcttctagtcaatggattaaaccccatttcttttacatcaaacttttcatctttcaaatttgaataatcatcaccatttgaaagttgctccaaagacaaactatattcctcccagtcagaaaaataggcactttctctagctattgagggataatcacagttagggccatgctttaaatcacaatgatcaccgttgcagttaccatgcttttccataattggtgattttagaagccactcctctaatgtgagctccttccccattttctgatgctgctcctctttattcttcttcttttgcatcaccttcttaataagaaagtaagtttgcttgatatttttgacaatccatactactgaactggcctttacaaaacatgagtcttccttaggtaatctttggcgcctaaaataagcctcagaacaacagaatgaaaagttaattcccattccgtttgtttaattgcaaatgggaagggtcataaggatagtggtatagactgctaagtctattatataggacacctaagacgtattatccaagagttaagaatattacactccatgcctttgttaatatcaagaagaaattaaggaacataattgatgaatggataaccttaatttattttttacagattaaataagcatgaataaaaccttttgcagtttatttcttcttcttatcacttttgataaataaaatatcacgaccacaactagtaattctgaatatctcagccacttatttataattatatgcatatatattagagagtactagtggccgttcaatgtttatatttgaagtaaagtgttaggtgcaattttacattagttagaaattgaaagattgaatatcacataagtaataggaaaattcataaatttgagggttttgagttgaaatatgatgtaagttcatttatgtggtgtgctcaaggtctattggtgtaaattttctgatgtttatcttatcgattgcacaacaattgctatgatgaaaatgaagacaaaattcttagcttatttgtcaggataagtcttaggcagtgacatttagtttggcggtgaagacaaggcttcccaatcaaacacataaagacattgttgacttgaagaaacacagttaacgttgcggctgagaactatttgccttggttgcatctaccaaactaccaaattgctcctgtaaaaggtaaccctaaaatcaagctagcagtaccattggagcaggaatttataaacaatattcatgaatgaatatccaagttgaagacagcatcctaaactaaactatgttggagtgaagacaaaattgcaagactgacaaacagtgaagcaaaagcctgagactccaattatatgatcgctttgtgttcaactgttcctctatcatcacaaccgcagataaagttgttcctatgccatatcccatgaatcgatcaagaaaggataaatttaaataaataatacaaattaaataaataatttgaaaaatgggacagttttgaaaatattttgaaatctgggcctgtgtaacacacccaaaatagacatgtttaaacacgtccaatttagacgtgtttcagctagttgtgacacgtgtcatacatgcacagtgtcgagcgaacttcgaacgatcataacttttgataggaatgtccgattgagacgtacgatatgtcaaaacgctcgaaattcagagaggaaggcttggacaactccccaaagggaaattggtcaactgttttttttaaaaaaggtctctaagtatctcaaaattacgatttatgattcaatcagtcaaaaattttcaaacaggttacttttttaattatttaattagttaatttaatgttattttctatttttttaattacttctcttaatttcgagcattttgacatatcgtacacctccatcggatatttctataaaaaattatgactgtttaaagtttatacgctcaaaattcacttgaactcaaaatttatgcatgtgttacaaaccaatttgaaatctattaccaattttgtttgcaaatcaaatcaacaatagtaccatgttaatgtatgaaagttttgtcccatattaagatgacgccatcttttttctttggtctcttatttatttcttttatcaataaatagaaattttattaaggagcatagggggtactttaatccaatatatatatatatatataaattatttgttagatttgttgttttcagttttggatctctttttaaaaatatttttagaaaaaatgttttctaaattttaagtaaataatttttactcttattttttattttctttgaaatgaaaataaaaaatacttaaatgaagctccaccttaatttgtagttgttatcggtattggtttgagattagagtagtgtgtatttgtttagtcaaagcaaaaataagagagacaaagaaaattaaatactaaaaagaaaacaaaagttaaaaattaaagggaagagattttgatcgtatttttcccttttacattctccatttttctcctatctatttaagaactagatttatatattaaggtttaggttagacagaggagataataggttccgcaagtaggactaccatagttttaggtttcttctacatattaccagaaaatgagaaatgaaagtttttttatacacattctttttttgccaaataacccaaataaggtaatgtgattttggtatatctatttaccaaaattatactgtaaattttaacgatttcagtttaaaaaaattaaaaaattacaatattgcggccgcaacactaatttcgaaaattgaaaaaattataatgtaaatttaaaaattgattttaaagtcgtatgctaatttcagtctctattttagtctataatacattttgtgacggaattcatggtcgcaaacatttagcgatggaaattgtggtcgcaaacatttaacgagcaaattaacgacggaagtgatttgggcgtgtttgacaattccggatttcaaattattttaaaaacggctattttttgaattatttattaaaaaagtattatttatttaaatttgccaaaagaaagtaccttttaactaaaattcatttattgaacgacatgcaacatattactttattgctaatgtagttcaaattaactatcatttggatggtttggacaggtaacagattcaacataaagggtgtagctctcaatttttccccctaataaacattgaatcagctatacagattttgataatacttaaaattaagataactcgtccttggagctttggatttgtctcttttaaagtaaacaactcaccttagaagataaagtaatatcggtcgttgataaaaaaaaataaaaaaatcaattgttaatattatgtttatggtgcacgcataacaaattaaatgcgttgaaatatcaactgcgaaatttcttattaacaactgaaattacttacttttcccctactcattttagaggagtcatgaaaattcagacttgcattttaccgtgttcaaaaattacttataattaaatttttcatggagatttgtttttaaaaaatatacatttttcgctaaacaataatcaaagcccaacatgtaccatacagaagaggtaaatgacgctatcatcctcagagtggaaaagacccaaaaagaaaaacaatgtgaggtgagattgtttttcatttctataccgttggaccactgctttttctcttgggcttttgtggcccttttccacttgtattgaagaccaatactaaatgttacgaatagatttcgtaacaaacacgcgaaaggtgttttctgcctaatttttctttatatttttttaattattttaaggaaaataccatttgtgcgaattcgtaccgcacggattatctatacaataactatctcctcctgaattgagtcaaaagcctagttttttttataaaaaaaaattcaatatctatccaattatatttaaacaagtagattcgtagtaaaaaaaaaaaaaatcgcactgtatagcatcgctgttattttaatcaacatttatttttaaaaacactgcaacatagatcttatgcttcgtgcgcctattttctcgtacaagcagcagcatagttgtccgataactggatggacttcccagaggcaaaaatcttttcattccagtatggcaaaaaaaaaaaaagaccctcatgtaatgcaaggcaactacgatttaaggaccataaaaagggttacttgtttctctgttaggtttgctgcagctttcttttgcaggtccagacacaacagtttctaagcaatgttccccaacagaaatgtcaagggtaaaaaagttatgtaatatggtagatttaagttaagatgtggaattattctatggatctgtttgtttaaatggttcaataagatgatcaagcgttgaaggctcactgtgactgatatcggagttcgaaggataagatggttttttggtttcttgtcaagtctctgtcaatgtcccagtgacgacacaatcacggtaggttaaaagttaaaacagatcagaataacatttcttggcatagccataagaagattcaactgttggatcttttcagatgataacccaaataccctaacttaatccacactcccgctccttgcttgaaaggaaacgggagtttaaggataatatggttaaacctaccaaacttattccaatttagttttcatctgacaatttccgtcaatacaatgtggcccggctatacagctgccagaactcatcactatcttctaaaaattatgccaaaccaaattgtactaatctctgaaatggaacttaagcaacaagttattatgatgtactaaggaatttcacaactgagattcaaatcctcagggtcaatgggtgaatgaacactaacctgaatttgagtgcaagaccaaaacaaaaaaagaaaaagagaattgtcccagacagaactgaaattcatcaagcagacatctcttatatgtattacaattccttgacaaacaagccaatctcaataactaccagataaacaagaaagattgcagtcccagcagattttatgatttccattcatcttccccaaatttcttcacacttaaaatgcatgatgtatgtaatatacaaaacaaggcatgcaaataataggtagaaaaaccattgaaatccacatttcgatttacataacatcttactggccagctgatggatttgtcaacaactcaagggatttcttcaagtagtctactgcaattgagacatcatcaaatgccagtgccccaacagcaaatcttgcagccttgtgtgcttctgctattttttcaggtgctggctggtagttactgtcatactggtatgtctgagtagttgacttaggttccacaacagttccatttctgctgctggaactgtgttgagcacttgatgaatggtttgcagttagcggagccgactgggaagaatatgaagcatctgacccttgataataagtataatttgatgggacagagggaaggctgctttctgtaaaacttggataagactgaaaatggggataagaaaaagaggaagtttcatgagaagggtaattaggatctaaatgctgtgaattctctggtgagtattgctgatggttgtagggctcaggataagaactttctgatctggcaggtggaggatggtaatcttgggaaggtggaggaggatgataatcttgggaaggtggaggaggatgatagtcttgggaaggtggaggaggatgatagtcttgggaaggtggaggagaatgataatcttgggaatgataatcttgggaaggtggggtgggatggtagtcttgggaaggataaactccaggtgtgtaagagtgagatgatggagaaacaatggaagaatgcttgttattatctactttgtcatgaaaaggcatagatggtggaatatttgcagaatgttggtcgttaccagtatcatgaaatttaggagcaggatgaatgcttggcagattctggtagttgacagggctatgataactacgtgatgaatcagattctggtccaggactggaaacagtagtttcggtagtcccaaggtcctgcaagaataaacagctcaatgttaattgtttatatttattaatgaatttatttatatgtttttttaactgatcaaacccagaagacaccaggtgaagttttgaatcatacatatctatcacttgaagaactcaaaggaactgagaggtcctcatcaccatcaggggggccagcagtgggcttccttccttctttcaaagcttttcttatttcagctgctttccacactgcatatttctgtttctgctccagctgtaaaagaaactcaaaaaagcattaaacatacagttacaggaagttgtattcttgctgcaaattgtttccaaataagaaaggctttgtggaaaacatgcaaatgcaatgagacatgcataaataaggaaggttcaattctatgcatgaaatacacacatcaggctgaaccgctccaaattgattaagaatctcaaaaaagatgctggcagcataaaatgttttcgctgtattcctgcaaagtgtcaaagaatatacgttaaaaacttatcacagatgaaaaattcttacaagcaagatagttatgcaaagggttttttaataatactatagcaaatgtttggcaaaagacagatgcttggtatgtaaagagagtgagctactatcttgttcaagacaaagaaacaagaagatacaaaaaacccttgtaaactttactgagagtctgagaccatagggatcacagctgatgcaacagaaccaacatacaagcttaaaggcttatttatttatttcaagctagcattaaaataaaaagagtgattttattatacaaatctgctcttccggcacgatcttgcttgtctgcttttccaaacacattagaagaaaatccctcgagatataaattgtcttcaggccccaactgaattgactttttatcctgtaaaaacaacatatttcagatacatcaattgagtaaataaaaattccataatcatacccaatcaaacatgtcaaccactaacatcttcaaaggaaagaaaactgcagattgccactgaaacatgccatagtatcattaattcattattattcacattcagacacttccatttaacatgagcagattcccttcttattttaaaaatcaacacaaagggatccacgagattaattaaaaaatcacttttatatttatttatttgcggatcacctttgagtttcagttaattgtgattacagtcagcataaaaaaacaacaaggtttactttagaaccttttcaagctgcttcatgagggaaaccagaagagcattagtggtcttcgtgcgctcactttgcggaatcttcagcccccgttccatagcatataatcgacctaattttaccaaaaaaaatatttcatcgtgataatttataacgacgattagagtatttcagatcagtgaaacaacaaaaattgccataatgaaaaataggtatcgatctaaaattaaaataaaagagagaattacagtaataagcgacgagtggttcgtgcttttgcaattcatcagcgcgttgaaggtatggtaacagcagcttcgcgggttcgttctcgttcgccatctcaattctcgcaaaaattcaaaacgcagaaggtattggaaaccacacgacgtcgtttgttggctttattccaaacttatgccttcgaccgtctttccctgccaaacaacaattaaggaaaaaaaaaaaaacttctcagctaagaaaaagtaattgctgtgataatttaaaactgaataaggaattataaataatatattatgttatatttaaaaataatcaattcatatgttcgtgctattttttattttaaattatcaatttagtcatttgcaagatcattgatgaaaaggatgacttttagaagcatacaatttaatttcatgaattcagttaagagggaatgctacacattttctttgatattctccatcaatgattctgattgcttagaatttattaaaaatcattaattttaataggttttgttactcattcaatataaattagaagaaaaaataattaaatgataaataaaacctattaaaaatggtaatttctaatacattctaacaaattatagagagaatcctataaaaaatgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgagagagagagagagagagagagagagagagagtgtagttagcattattcttcaagtaattagatattcatttacgatatgcttagctactagaatatgagaaaaatagatgaaaaattaaaattttctcttcttcaaatacaaatcaatgcaactcaataaataaatttagggggctagagaggacaagaacattttactattaaaggtttaattggactatttaggagttagtattaagaggaaatatttaaataatttatgcattaacaatataaaaaattatattattattttatcattgacatgtctgaaaaggtttttttactttttcaataataataaaaatgagaaacatatattttaatcaccgtatttagttaaactttattttagtctctatacttttaaattgatgaatttattccttcaactttaaaaaatgaaaatttaatccctcttcttgtttaaatttaacatttagtattaatttatatattttctaaagttgaagggctaatcaatttgaatgtacaaggaccaaaactaagtttaaccggtacaaagataataaaaaatcctaagaaaaataaacataccattcatacaaactaaactgttattaaatgttttagaggttttaaagtataagtaaaataagttcaaataccactaatatgttgatgattcccaatgggtagtacaaaaattactcttgattgataagtaattacccacttaacgagaatgatatttaggatttagatacaagcaatacgaacaaattttgacggataagaatgcagatataagtatcttagtatcaactctaccattttcaatgcattaagcaggtaagcaaaaataattattgttataaagattattttgtatcgtcaattgaactttgcacatcactcaaaactctaaataaccaaatctcaccactaaggacatggtttaactagtacaaaattgtctcatattaacaaccgatcttgagtttgaatcattagtatttatccatttaatactcaattaaagaatgttattcttcatagtaattctatcaatctcgagcaatctcgagccaaattgtcacatgtcacatatgaaagatacatggaatttctaaaagaaaaaaccctttatacccttttctttttgtaggtaattaattttatacaacttgaataataagtaacatttgattaataataccccatgcttgaaaaatactatgcgattaggaccattttattgcttgcaccgtcagtggaaataattaagaataataggttcaaatatataaaattaaataatacaatatataaaaatatgagagtagtgaattcaaatatataaaattaggggaacaaaatataaaaatattaaataattatatgtatttttttaaagtgaagagatggtatatacaccctccctatgttggagatccgagatctgccactgtgccctgtgacttaaatatttatgaaaacccaattgccatggacatgatgctgaaaactgaaacatctcacaaggagaaaatgtgtgttcggaaatttgcatttgacagcatgaagccggacagcgtgagcaactatttgttgcttctgcattttttccattctttgacgtgaaattgcagggtagacgtgcatatgtaacatcatttttttaagattatgtaacaccatttcaaacactgaaagtgaaacaaaccaatgaatagaagctagggtttggaaaaaggcaagactagcactgaagactgtatattttcatattatagggcatatctattgagaaaacctccaaatggcaaattgaacatacacagctcagaacagttcctctctaattacttgtcactcccatattataattcctaaagcactagtaatttgacaatgctacaaagatgaaattatagggttgaaaatgaagatctcattattagggtgatgccgggatgggttcagtaccagaaacatgggaagcagcatcttcttttgacatggccacataattcacgggagcagatagtctgttttccctttttccatcttttgatgtggacttgtttccattttgatgagcattaagcgatagccgtcggttaggagtaccattggctcctccgttagcacgaggacctcctgacttactggaactaactggcctagcagggctgggtcttgaaccaaagatggtttcttgttctgtgtttcgctgctcgtgatgctttttctgatcctacaaagtgcaaagtccatatgttatgacctctccgtaccacagtatgtataacaaatatagaatagtagtgaacaaaacagaaataggccaagctgatagttttaatttcctcgcagagttgtggtcttattactattagcaattgctcaaatcaagctgaaaatgagtaatcctaatcatcttattagtgaaaattaccctcatcctccgtttttcctcttcccgttcatgtctgagcatggcatattcatctaacatggcaagaagaggaacgccatcatatgtaaatgacatgccatgatcttcttcccatgcacgagttttagcaaccaatgtatcaaccaaagctgcattttcaccaacagaaacaaaattattccaataatgtggcatcatcttgttttgcttacactgacagcagattgaattaataataacagtatctgatggtgattgtaatctcattcaacaaatacctggaattttgttgaccaatatccgagctttctctgcacgtttgaggtttatgtgtgcacctctgcttgcattatacctgttctcatcctgttttacaaggttgtgtcagagtgtaacattataatccaaatgaggaggattaggcaaccatttaaagatcataacttgcagcaaagctaatgctaaaaatctaaatatttccggaaacagggaaaaaaacatttcaattatcttttcaaataacaaatcacttaaactgaaaactagcagactatataataaagacggatacagattaactctggctaaaggatttacaatttttgttaacatgatagtaaatgttcttatcataatactactacatcacctctctatccacggctgtgcacaaccaatcattcaaactcagaaagagaaataaagcagaagcgagattttaagtacccggttatagtcttcaagccaactctcttcttcacatgctgacatccatttctcaaccttgtccaatatatcttttcggcttaaagcttcttcttttgcttttgctatctgattgtccatgtcagccagtaattcagttggttcaatgtttcctgaatcaatcattgccataatcttctcccgggcagcatctggatctacttctatatgagcacgggcaaatatctcttcaagctctgcctgcttcttgaaagcaatttccttcatcctgctggctttcagctgatcaagtctctcaacttccacttcagcctttattattcaacaaaaaaaaaaaaaaaaaaagttaataacatacttggagctcgaatctgtaaacttcagaagttctgtagtacctgctcaatcagatccagagcaagggcaccaggaacagtgacttcatcaacagaagctgacatattacaggtaacatgatcaaatagtctcctttcctcgggatgagtatccattagattccaaagatcaatcaactgagaagctaattcttggagctgcatgaaatatccaggtcaaagtaaagaaaatggtattagattaaaagtcaagcaagtaatgaatgcaaaacattttgtcggtaatatcactctggggtgtcaaagtcagaattgatggtgatttcttgaaaacatacacatgattagcaagacaaaaaccacagtatatcaaaaatcctaaaatttgatagcttatacagttaacagctattgcataaatgaaaattaaggggaagaaatgttctaaatgcattaccttgtgcagcctctgttttttatcttctttcagtgttaagacagtcttagccagccttgctagggtgtcattacttatgctcttcgattgaacaccagtagagtcatttagacttggatgaacctcagttacagtactgaagaagtccataccaaggacagcacatagatcatgcacagtactcacaaattcaagaaccttgtgcaacctctcgctctgccaaacaaggcaatgcaacaaaactctcaatgagctgtttagtgaatgaaatcaaatggaattttccaaattagtgacaaactgaaatgacacattattgaatattataacaaaattaccttttccttttgaagttcttggagctcagattgatattcatctaacttcttcagggacaggtcagactcatcaactgcaggtgaaacatcattaaggttcaagtttccggctatctctccacatatttgttggatctgtgactgtacatccgagaactccttaattctttcttccttttgttgccataactgttcaagtaccggtgctatagctgcaagctgttctttgatagttccagaagtattctcaggctgtgaaagaataaaaaatatgcataggaaattagtttgccactttactaacaatataagacatagtcaggtagttactaacaattccagcaatgctcttttctccaagtgctgatagaagagtggaaagctcaagcttagcatcagacagagcttgaagtagctgcgcccttgacttggcagcctgctcaacctttctcttgtacacatccaagcactcctgctctaactgaagaagcatcttgtctcgttgctcgtcgctctcaccaacctcatcccatatttcctacagcgaataaagaaaatgtaattacttaatcccattattctgtagagcattcgcatcttaagtgacacagatgaactgttgaatgaagttagttacctgaagcttttttaacaaggaaccacatgtgttttctccaagaagaggattttgagcttcggtcactgccattgaagtcccagcgacacctagcctgcacctcaaaatataaaaatgacatgaaaattctttctgcttccaccaaacgcatagagaaacatttcttctcttccatgaagatcaagaaagtagaagacatctgctataagacaatgcaaatgcaattaaagcataattaaatgcaaagccgtaatccatcgtgggtaaatgttgaattccggtaacccaaaattacccatcccaacaactaaactaacgaattcaaataaggatctttgaagagataagccaaaaaaaaaaaaaaaaatcttaatattaataaaaataataattaattaattattgttaaaaagtaaaaagttttttaattgcatctgtaaagaagtcggattttgttcattacatatgacatgatcataatccaatgcagaggtaagctaattaagctaacgatcacaacagaatgaaatgagtcgacgaaacggaagctataataacccaatgatcagcaacaagtagcaagaaaatgcgatgatcgagaaaaaagagagggaaatgttcaccgtcaagctaaagaaaagaacgaagcttgaaaagaatagacgaaagaaagaaagaaacgcagcgtagaacaagaagttgagacggagctcacttgcattcacagagcaacgaggaagaagcagatcttgggggatgcggagatcagacgaagaagaagaagaagaagaagtcgctggagagaagaatgcgtaccgtttgaaggttagggttatgtggcttcagatctgaaacagagcgtgagcgagtgagttcgtgaaagagagagaaagagagagtgaggttgtgttgtgtagagtgtgcatataataatggggtcataagaataagattagatgatgagatttattagaacgaacttagatgatgcaaaagatagagtacagtgttagtgtaggaaaacaaaatggacccacaatgactatctatgatctatcttttcccttgtctagttccaagtcaattcgtttcttgccccaactcttcccccttatttacgatcatgacactgtgtctaaagtctccctcactcttcatttttttcaaatgttaccataaaaactttgactttgactctcggtctgtctaatgaattttatttaagatttaaatttactctcaattcaaaaagttgtgtattcatggaaaatttatagataattattagaatttaacttttatgtgttgtcggtataaagatttttatacagtctaccaattaaaaaaatatatatgtttttaaggatagttattataaaaattaataaatccttcatacaaacataactaaagcctagaaaaagaaactcgcataacaagaaagctgtcaatgggtgaggagaagaatctaaaacagtgaatatatctgatgatgatgatcccatatgaactaatcgatatatatacgcattgctcctcttctcgatagacatggttaaaacttaggacccaaagtctattcttgaaagattgaatagagtttatcaaagcagcatacgaatgccaaggaggttgatcatgattaataagatccaaagccacaagtgagtatgattcgcattcaacaattaaaagacaatgtttaaaaatttacactatcaatgtattttaattactattattgttatttataataattatcttactataatttattagggtcttattaatcagtatttttatgacattgtttaaaaaattaaaagaagagaatatttatttgtaaaaaccattgaaaaatataaaaaatcataaacaatacatttttgtgtattttaaatttagtaaaaatttagtttttaattttttaaccaatgcatcaagtaaataacctttctaaatttattactactatcttttaatatttttttcatattaataacataccaccttcttataactgccaaaatctaagtgtgtatttgcatatatcggctaaagtcaaaaagtgcggcctctcatattctgttttgtgagaagaaagtatttctattttctaaagttaggaaaaggtctgtttgggatattcccaacagaaaaacaaacacaggcttaaacaagagagaaatcgtttatttccatccacctaaacacattaccaaaagaatccattattcacttctaagtacagggtaagttgtttacggaaaagcaattaatgagcatgcacctcaaattgccattttatcacattacaaggcaactaagtattgcgccatgctcatgtcacagcaccagttatggggtaagcattgagctactattcaatttccgtgggtctaattaaaaaagaaagaaaataaaatgcaaaaataatatgaaatgcttgtaaaaattactatcaaaagccagcaaatagttagaaaaccatagaaaacataatggaattgataaaaaaatttgtaaacaattaaattagaaatcgtaaaagtgtaaatagttaattatgttcgagataaactcaatcgggagatgtttcaacttatattcctaatgtaatttccattacagatggccaaatattcttatctgccgatcttcttcccgtacagagtctgtcaaactccgctgtcttaaatgacattggcgcggtactctgatatgagtagatcagatcaatcgactgttccggctaatcacgtcacgaaatagtagttactcccagcccctttcctttacagaagaacaaaaaagtttattagttgcatccgaggttcaaagccctgctcatagaaggaccaatcttgtgaaggacgcagagggctaattccttctcgtcgctcaatctggagtaagaagccggctaccagcacgagtgtacacatcttgggattcaaaagggcttctgcttccctagtgaatgtcttggtagaagatatgatttctttgaattgagatttattcgtctttaagtaagcacgtaactcaacaagaaatttcctgtcgagagttcggattgctctacctaagtagaacgaaaagaaggaattggaaattcaacaacaaagggagagccagaagcttcgcttccggtagggggatattagattgattgtatccatatggggtaataataaaagggggaggagagcttaaaaaaacaagatagataacaaataaagtagaagtgcgggaggtcaaactggagattcatattgatcaatcgatctccgcgtcctgccagttcgctaagtagactcactctcccgaggggcaacaatggaactcttcctgccaaaaactaatcataaacatttttataaaaaaaaaaaataaagattgattaatattttatgaaagattatctccctcactagactcaatcttctatgatactctacctgcaataatgatttattattttgttttgaaaccatgtgcttattttttagggattttgaaaccatatgttggatgtgtgagaatgggtagtcaaagcataagaacgtggaattgcaggctagaatacgtccatggagtgcaataaaggccaatatcgttataaaatttaagggcaggggcaattgctagcaacaaatgggggaatgttaccctttttctaaaaaaaattgtgaataattatttaacctgaaaaaaagcagaggataggaaaactccatagatgggcaaaggcaaaggtcgcggtcagggatagggttgtcatcacgaatccaacacgtctctgtccaaatgagtaatgacagcatcaatgtgaagctacctatatttctgtttagtgtataatatataacccttctgcaacgtgacaacattttcatttcatcactttccttggaccataacttgcattctcattattctacgtaagccatccattatgagaataattataattttatcatcaattgatcatgcgcgggatagcctctatatccctacatataaatataattgctgcatttgggatggcctacgtttcaggccttttaatttattcagtaatatattatgtatctatcattgcatgaagtgcatatgatatgaccccaaaactactacccctggtgcaaaattcgaatttaccaattaattggatggtttaaaacatgaatcggtgtataattaactggtttgataataagcttatttaatgatattaataaattattggttaaaatgatattgagcttaattttattaagtaatatcttatgtttgaattttgtgaatgaaataatataattaaaagaaaaaatttcactcaaaatgatcaatcaatttttaaaaaaaataataattttatcagtgaatactccatcctcgtaacatgattaaaaaaattgatctgactctaattcatatatgtatgtgatcaaactaactaaattaaagttataaaaaaaactaattaaatgaaaagctaagaataaaaatcaggcaatgattcatttatgcatgcataatagtagagacgtcacacttcgtccatcattttttccacttgtatattttcttttattttcttccttttaatttaagacaaaatgaaagggcagagacagagtggctttcaaatctcatttaatttatagagtagaaaacaaattattgcttgtatatcaataataatactatcctttttcgatgtggcaatcatgaaattaaaaattggttacatgatcatcaagtacataactgaggtaagccgtaagctttttaatttgaccaactgtgtgaataagtagatgagagagtacagttttagttagaaaaaagtacgagtaataaattattagctcttttatcatccaacctcccactctcaccaatgtccgtcgaatcagttaagtaattaacttgaatatgaacttaaaagacacaaaagttgtgtcactctttaaggtctcacggggatcgctccatagtttaggatttatttgataaagtaatcctttcattcctcatttatgtttttagtttttttaaaagttttattttagttttataaagtatttttgttatattaaattaatatttccgacaatttaccacattaatattattaatcatggttgatgtgataattgtcgattcctttaaataaactaaaagaccaatttaatctaataaatacactttaacaagctaaagtaaaactttttaaataagatcaaactgaaacttaaaaaaaaaaaaaagaggagagtctaaaaaaaatattttatccttttgtttttctttattctggataatgatatttaaggatttttaaatttaagaattaattattgtgtagcttcaacattagaatagttgatattgcaattcttacacaagcattcgtatttttataaacaactcgttcttaacaggtcttaagaattgtgagacaaatgtataattaattttaaatttttaaaaattgtacaagtgaaattgttgaaattcttcaatctcatgtaatcttctaaaacccactaaggaggtgtttggtacatattggtatatatataaataatttttttagttgattatagatatttatgagtttttttaaagaaaaatataatatttttattataaattttaattattaatcacattaaataatttaataagaataatataatatttttatcacattattttttttataactagagtaagttagatttctaatttcccgtggaaacaactttatggaaaacttagcaaaatttattcacggacaacatttttttcttctagaaatgttacgcaaggttctaaaaactaaaaacttcttctttatcaagcgtctcctcctaaaaaataagatttagctcaactaacgtacagtctctaactttagagaaaccaaatcttacaaaataagttagagagtaaattacaacaatactcattgagcttttattaaattacatataatcttacccttttttattttcctacattaatctctttatatttaaaaatattttactaatatcatcttatatatgttggataatattattctgatactccctaacatttccttaaatcttaaaccaacactttctattagaaatatgaatgtaatagttaaaaatataaaaaatatttatataattacatgaaatattgtgaggtattattttaatttgttccaaattagacaactctatcgtaattacaatattttagatggtgttacaaacatatttccttacatgttttatacaaatctatcattatttatttttctctttttcacaaattctctttttttctctatacaatacccggtttaaattttctgaggtctacgataattttctggttaagaatcattatcattttattctgatatgttatgaattaagggtgtggtattttatttacctgccgccaaaagtttctatttagaccatgtattttactttatttattttagggtgtttatgacctaatagttctaaattctaatggcgctgtacaattagaaaagcaaaaaataaaaacttaagtgggaaaagtcgtcttccatttcccaaatagacgacttacactacctgggttatccttattagcacgaatgttaccaagtaccaacaatggtcttctaaatataataaagcaaaataaataaattattattcagctgttacccatggttataacatgttacccatggttataatttataaatagctaattaaattaatggttaaattcattctctttactgaagtcaaactccatcgcttaacttcattaatttcaaacaattataaaatatcatcactcaaagcaaaaccaaaattaaacccagtaatatataactttgttgtgaaacaactactgatctttactattctattaacggcaaagacattatattactcaataaaaataccagcaaattagttaaaagtaaatatgaaatccaaatttgtttggtatgaaaagtttccttcctttttgtaaactcgtaagatttgattatgaatattaatttttctaattttatatttactttatttaagtatgaattattttatgctttagtaattggtaaagttgtgctttatctagaataaaatatgaataaatatattttataactaagagaagagactaaatgtaaattttatataattcttttgtggaagtgaagtatatactagtaagaacaaagtaattccaaagagaattaaaagcttgaggggaccatgacacactaagttcgtctccctccctccacctaacaactctgtgttttttgtacttatctactactattctttagatagcacagtttcatgcttgttgctcaatacatggtgggtttagatttttttccaacacacgttatgtcctgtccgaaaatcaataatcaagatgccaacaatggaagacacatgtgggttggggccatgcaacatgtgacctacgcagggaattaatataataagatctggaacttgagaatttgcatagttgcatttgaccagcccaaagcacaatttctaacgcagtcacatgcatttgtattctcaattatttgctaatcatcgaccaaagtgaccatcttagctaaaattaaacagtgtggtttaattataatggcatcatctctcatgtgattgtattttattataggcacaaatctttgtaagccctgttcttgttctctctcgtatcatacctactttctttcttgtcgaattatatacctacttccttgatgattaaatatatcgtcatcgtggacccaattctttggtttgccacaattgttgttacgccaactgaatggaattaatgttcgttctaattatagtttaatagaacttttgattagttagggcttttttattttattacttattttttaattttaggttttgatcctctaatttttagaaatgattcaattagatctttttttaaaaaaattatttaggtcctttattatttaaaataaattcaatttgatcctaattttcttttgtctactccaatatttttttttaaaaaaataagatcaaatttgattttaaataggatcaaattgaatccatttaaaaaaaataagagacttaacttctaaaaacaaaacgacctaattgaaatatttttaaaaattagagaacctaattaaaaaatttaatactaagaggatcaaattaaattttaaaaataaattagaggaccaaaataacaattaatccttaattttacgttgctgacaattaattgtagtatctctgcattttagaaagaataagttatttccaaccatttaaaaaaaaaaacaaaactgtaataattaggaaaatcgtgtctatagacacacgttacaaacacagaaaaattgataaattagacaaaaacaaaatacaattttttgtctacaaattttaaaaaataatgtcatagacgtgtaaacaaacacactaaagaaagagagagagagaaaaaaaaaagaaaaaagtgtcataaacgggttggcaaagtgggtcagcccaccaaaaataggccgggctggcccatcccactaaaaatgtgggccgggttgggctggcccacttttataaagtgggctgaaaatgtcaacccaccccactttaaggtgggttagtggaccagcgggccagcccactaacccaccttaaaaatatttaataaaaaaataaaaaatatttttttaaaaaaaaatatttaagttatacgaaaaattaatattaaattcatgcctgcaatcattttaataccttatctcacatgagatgatgagaacttgagaaaccaaaaacaacagaatcaaacaagtcttgcaacattcattgaacttccaagaacaattaaacaaaattagaatgtgaaatatttttttaaaaaaatattgtttaataatattttaaaaaaatatttaagttatactaaaaattaatgttaaattcatgtctgtaatcattttaatattttacctcacatgagatgatgagaatttaagaaaccaaaaacaacataatcaaacaagtcctgcaacattcattgaacttctaagaacaattaaacaaaattagaatgtgaaatatatatgtaaaaaccaacctaaaatccatggaaaattatatgttattagagtctaacactagattaataaatgaaattaaagtttacaaagcaacatccataattccatacattaaatttaaaatgtaaaaataatatttttttttggtgggccgtggcccgatgggctggcccgtcccacattttggcctgcgttttagtgggccgggttggcccggcccattttcctaatgtgaacttgaagtgtcaacccaacccacatttttttgtggattaaacgggccggcctgccggaccaggcccattttgccaaggctacagtcatagtcgcaagaccaattatactgaaaaaatatcacagttaattttttggtgaaatctaggtaaccattcagatttcagacgagaattctctatatggaattgggtatgtaattgggttactcatgccttgactccttttggatgttgatggcgttgtattgtcgctctaaactgtctggttacttcttgtaccctgttctaatattaattgaaaagttaatctttgcctaaaaaaagttttgatatattaaaaatcattactatattaattacacgtacaaaaacatgaccaagccaataaatattattttgtatcatatttcattatctaagaattattaagaacataatcgtaaattgtgggaagaaccaaattaaacaaaattttaaagataaaaatcaaattaaatttaaataataaattctttaacttttataaaattaccttaaaaaatatgtaaattgtatgatatattataatgttaaattttatttcctataattagggatggcaatcaataaataggctttgagtatgatactataatatacaccctaaacttgtcttttagaaaaattcttatatttatattcatactcgatcgcgtgaataataactttaatatcatgccgtttttttggatatctaaatgttcataatcatagccattatccacattttaaaaatagtttattttaaaccacaattataaatatttattataaattgtaatcatataaaaatatttaggctaaaatataatttccatcatccacttttaaaaaatttattattttagttctcttattttttaatttagacatttcattcccttttaaaaaaaattgtgatttatcctcccatggctaatttcaaacattgaaattacatataaaaaggataaaaggtaatttacaattgttataaattacgtgtgaaaatgagaatttttagatatgaatgaaaattatattacatatttctaagaatagtatttttatatatatatattttaagtttagatttatttattattattttaaaatatattaacgttaatgatgattaaattatatattatgaaaatatatattatagattgtattttttgttagtgtagtttgatttaatattaaaattcatattatttaatttttgccttatctcaattgatttatataataataacatgaattatgttaaaaaattatttcaatcaaatcaattaaagttacacgtaggttctcatagttattagaaaaattattttttaaaataatataatttatagaaattacgaagataccatgtgtaaatttccttttcaaaaacattttccgctgtatatagtatagattaaaaatgatagtaataataatatatatttatactataataatatatattatagtacaattttattaaaatttgaaatgtaaattcattaaattaaattatattagttatattatttttttaatatatattaaatcaaatcagattaattattgattcacttattcaaactcaatgtcgtaagacttattttaacgacattgctcattggcatcgagaaggagggtattattgtacaggacaactatagaattgactagtttttttgttttaagttccatgaaggtaattaattattgttcatctgttaaacatgtcgtgttacttttatcttttatagtacattttatgatattagtaatagatttatatcataaagtttttatatttattagcgttttcagtaaccttatgggtctggacccgtcacttagtataataaagtaacccacgattattactggtcaatgcggaccattacgtatctctcgtagttaatttgttctctcctactatgtcttgtgctgttaattctcgtttccccgaaacatagcaaagccacatctaacatcataaaaaaatttctcaattcgtattgatccttttgtcattttttacctcttaaatccaagtatgtactcttaaatttcaatctgcttctccattctccattgttatttcttttttcttgatatatagtttccattatttcgttgttagaatcattatcccatttctgttttgagcacatgaaacttgtgccttacaagaaaaaagggtttcgattttgtgagtgtgtgacaatcaatgatctatttttatgtaactttaataactatatgttgggcacatgcttattgtttcaaaaaaccttgaatcaaccatcgaggctcaaactaataggtcacattgttaaattttttgttgacggacgcatgcatgcatacttacatcatcaatatcattttgtacctagtgtccactaatttcgttgcttattatactatattgttgtgtatttaactttcccaattatgaaagtgattatgtatatttagtatgagtgctgaattttgaggatacagccattttgatacattaatatgaatcctattagggatgtgtcgtttgcttttataactttgccttctaatgtctcagggcaggtctcagtccgtgcatgtatatcactccaaaaatatttgaactatcacttcaacaatgagagatatacatacggatactaactgtagttcaccaagaacgccaaatgttcgacaaagaagacgctcaaatgaggttgatattaactgtagttcaccaagaacgccaaatgttcgacaaagaagacgctcaaatgaggttggtgtagtaaaataacatgtatgcttgtttgtgatcggggatacatttatttcaaatatcaagtttttttgtgaatttatgctgctgcaagaccagttatctatagattctgtcaattcagaaaccatttgattatgacaatatgcacaaaattattattcactcctctacacattatttcttatctatattatatccgagctatacaagacatgtatgaagagataactacgagtgtgagaactccaagagttgaaacgaagaactttcctattggggtaggattatatcacggctcagctttaagttcttgtttaacatagttttggatgtgcttatcaaggacatacaaaaaattatccctaattgcatgctttttgtggatgatataatcttgattgaagaatcaaggaaaacagttaacaataagcttgaggtagactttggaaacaaaggattttcacttagtaggaggaagacaaagcaaatgcactacagttttagcaagagacacgaggattttggctcagaagtaaaattgggagaggatgtcataccataggtttctaattttaaatatttgggatctatcatacaaaatggtggtgaaattaatgaggatgttacattagcaagatggcttaaatggagaaaagttttagaggttgtttgtgatcgcaaagtacctaccaaactcaaaggcaagttttgtcgtatagttagatgtccagccatactatatgatagtgaatgttgggtattaaagggacatgagagaaaaatgaaagtagcaaaaatgagaatgttaagatggatgtgtggtcacataagaaaaaatagaatacggaatgacgttatacaagagaagattgatttagtatccattggggaaaaatgatagaaaatcagttaaggtggtttggcatgtacaaagaaggtcacaagaggtgttagttagaataactaatttttcatgatatttagtccgagaaaaagaagagggagattgaaaagaaagttggaggaaatcatcaagaaagatcttaaacttaataatatttataaaattttgatttttaaccgtgtcgaattacatcatgtaatccatgtaaccgacctcacttagtgggataagactttattgttgtggtatcctaatctaatccagctttatatgtttccaaagcttattattattgatccatttggttggcatttcaaatgctattttttttttcttataagatacattacatgcagttgatgaagtcattattgaatatgaacttcccattaacttatgtatacattatttatcattaatcaaatactgtagaaaatgggccggggaaatagaagaagaaaaaatcattttaaagaatttgaaactgatggtttttgtgtcagattcctgcagagataagcaaatcaaatggaaacaatttgcttgtcaatgatgaatccaaatacaaatcaatgtggatccgtgcatactcatctctgtggatgctagcgagtgtctcactaatcatatacttgggtcatctttacatctgggccatggttgtggttatccaaatatttatggccagtgagctcttcaatctacttagaagagcaactcaagataaacgtctccctaagtttaagctcttgaactggtaagcattcatgtacggtaatttctaaatgattatttgcatatgagaaatgtttagtttaatatatagtgtttcacaaagatatgattctgaatgcaatgtccaggcattatttcttcacagcaatgctattcgtatatggccgtattctcagtcaacaacttgtgaatacagtgacttcagataaattcttgtatagatttgtgagcaacctgatcaagtatcagatggttatatgctactttttatatattgcaggttagtacttccaaatgttttattcataattgtcaccaaatttggtaagagagaaaacatgaataattataataaagatacctttaggtcctgtctttgttgggcatattcgtcataaatctgaatcaatcctgttacgtaacttaattttatctaatatcctgttaacctagtcttctgcaggttcaagtgtttgctgcctgtaatttcaaaaaaataatctttcattcttgaataagtcatttcatctgtgatttcaggttttgtatggtttattctttcattgaagaagagatattacaagtatcagtttggccagtatgcatggacacatatgatacttattgttgtgtttacccagtctgcgttcactgtagccaacatatttgcagggatattctggtaacatgacttctgttatattacttgatgatgaaatctccatcatctaattccttcttttggtttattttttcctattatatgtgattttagcttacttaaacatctttctaaatatgattctacgcaatctagcttcatttacatttgatcagaaaattgtagaacatagttacttacagaaaaggatacattaaatcaataaacaagaaatagtctcttaacaaattctttttaataatttgcatctttttttttttttttttttttttctgttagctttctgcctttctctaattcttgttttcattccaacttactgtatggttgtggaaaaattatatttttgcatacatttaatgtattgaaaaaaatatgttcaattttttatatgttgactttgatattgttatggacatgagtaaaaggataatcagatataataagtggaattttagtggtctttgaattaactatgttgttgctcaaaaatattaaaaatgtttctattaaatttgtggtttgattgacttgtacaaagatttctcattattaaagaagaggaagaaaagaacacaaataacgggactctttataaacatggcatcatgattcatgaaatttacaatatgtctattgtttttgctcccaaagaggttcactttcctgcaaaactaccatctgtgtgtatcctcactcaatggaaattctgggttctaatacgagtaactgctttggtattgccaaccactatgtttttcatgctttaattgattttattttttctagttacaacctaacatattaatataatcatgcaaggtttcttttccctgcaatcctcattgctatgaatgatgttggtgcatattttttcggtttctattttgggagaacacctctgatcaagctttctccaaagaaaacatgggaaggtttcattggagcgtctgttgccactatgattgctgcatttacggtaaacatcagttagtgacatgactgacatcaactaccatcccaaaaagctttcaaaatttacaccttgtgtttaactcacaacctccactttcagttgatttaatgatatttttcagtatttttgctttgcatgattatgtcacttatgtttgtgcagtttgcaaacttcttgggtcgcttccagtggctaacatgtccaaggaaggtaacaatcttgattgggtgcagtcatctatgaggaaatatttatgctgttcctaatgatggtgaaataaattcaggatttatcaactggttggcttcagtgtgaccctgacccaatttttaagccagattacattccattgccaggactgatttctcattgggtaagtaccaaaaaattaaatctatcctaataattacaaagagatagcatttttgccactaagcttaagattaagaatttaagactaaagtttttcattttgcaacattttgtagcttccatggaaagagatagcagttttgccagtacagtggcatgccttgtggatgggactatttgcgtcaatcatagcaccatttggaggtttttttgctagtggcttcaaaagagcttttaaaatcaaagtatgttcttgctctttatactagacatttattttgcatccatcacctttttccattcactttgaaactcccaaacatagcaatagcattgatctctttgaatgattacaggactttggtgatagtatacctggacatggtggatttacagacagaatggactgccaggtttgctcatagatagatatttatgtactagaattatccttggtttatatctgaataggctattaattcagaatacacttttcaaattttttatggcattatagttagtcaataatcagtaactgctatgattgatcttgctttaagtatttgggggtattttctctgttttatatctaccgttttgttatcgatgagctaagatatcccattgtcttgacatgttaaagtgaaattgattcattactaataaaatttatatgccctcgctatatacaccttgtttcaatgctcagcgctttcaatttcaccataaatcatgagcggctttctatgccatgctataaagtacacaaataactctgcagctattgtgagagtctgtgactgttgtgttttatactgtgatgcatcctctgcagatggtaatggctgttttcgtctacatttaccatcaatcatttgttgtaggccaagactattcagttgagatgttattggatcaggtgagtctctagtttaagcaatttattggctaactttcattcatgtgaaaattagaggattctgttttctttcatttccaatattacacacataaatcaaactggatacatttcattatggtcattacccataggtgtaacgctcaagtgttttatttatgtagataatgaggaaccttggttcagaggagcagctatctctctacacaaaactcgggaagatattgcaagaaaggcatttatgataagttcactatacaattaatagagaatgcttcagttggtgttttatttgtagaagaagaccctgttggaacaagtggtggagattagtaaacaatctttttagacctctttttagctgctgaactatgttaagtagagtgtaccgatccttgcaagtgacattccttcttttcctttagggcttaacattgacactttaaagcagaattgtattgagaaatatattggtgtttttcaatactgctttttattagtgttatctactattgatttatcatcaaagtctcaatataaaaacttgtaatgcattattctattcttaatattctttcttcaaaattcaatcaagaaattttctcacaatttacatccgctgaaacaacacacattcaaatgaacatgcaatttcattttcctgatttgttttggctagtgctcatccctcacttagttatgtactgaacctttgcatgttctctcaaccattcaagcactttagctccttctagtatttcttgaaccttcacgaaagtaaaaaaaagatcagatcaattaatccgcaaaattaggaaagagagtttggcccaaaccacaaattaggaaagagagtttgttgactgttgtatatgcatataggaaacaatgaagcagccaaaacaataaacaacagtcaacaaactcagaagtatggcacaaacctgtcccttcacccgttcctcatcatattcttgattttgacgtttgaattcagcaatggaattctcaacctctttgacaaggtcctcagtagcaaactacaaaacatacaagcacaaatcattccaataagaaaaaacactcaccaattaggcagtttaattataatttataaagcaagtgatatgtgcaaaccaaaatattatttctcaatcacagaattgtggtggccctaatacccttgtaatctttttacaagtgggaaagattttgttgtcagcgtgacctgagcaaatatttagaatggaaacgtatcttaatcaaacatgctacctgcagattttcacgcctatatatatcaccaactgccagactctgttttatcaaatttgttatattttccttctgatgctcaagaaattcgttcacagccttcgagcttgacagagtcgccagctgctgctcatttagtttcatttttgcctgagagaggagttattattaatttttctttttttgcattaaatcacgaataaatgtaaaaatttggaatctaagtcgcctgattagcctgaaaatgatgcaacttgcaaccaatacctgtatttctaataggttggctccgtaaagctgccttccttgttcctcaaacaaggattgaggtatatcaatttctaccatctgaaaatgacaagatgcacagatattttgtgataaaatttacatactccaatgttttcttgcagcataaaattcattaaaagaattatgtgcaggaaagggccaaagagagggaatccaaatttaaaggtaacttgtttcataaatgtcagaatcagattttttctaaggatatacttaccaccatacttgatatgacatagatgatttacaagatacgttatgattcaaaatcaaccatgaggttcataaggaaaggtaggtcttgtcatcttattacagaaaattgaagtccttgataatcattatatgcctaccagaaaagcataataacaactctagtgtatccatgtcagatgcacataattatgcacaatgtataagcatgcatattgaaaacatgtggcaaggtatgttctaatctagaagacgagacaaaatcaatccaatacatctacttaatgtaatgttaccttagaaatctgatctaagatagcattatcagttgcttgttctctagctgtttgctccacctcttgacatttctgtaacaacaagtctttgacctggaaattcatgctagagaattttactctaaattcaactaaaaaataattccttaatttacttgacaatcgtacttaagggtaaaaaagtcacctgctccactgtggtgcatccagggagaagcttatcagcaatagaatcatccagctctggtaaatctctgtaaaaaagttctttgcattcaacctgttatacataaaaggtatttacaataatcaagatcagttatatatgcagccaaaggtgtgtttaagcaagctaaaaggaaatgatgagatccaaacatgcacctaatgttgtattcatgaaaatgagttgagcactgtgtacactatttagaaaatccagagtttgaatcctattcctattgagagaaaatatagtttaattttggcagagggataaactatcccctccaatggaaagcaagaaggcaatttagacaacattgcctgaaagttcaaaaactttccttctgagatgcctgttctcaagtttgaggtaaagggtgctaggctagagaggagtagtttcacgccaaaaacttttcacaacttctctatctaatgaatcactgattttggagtcttttgcctaggggcagctattctgcctacagacttctaaaaatatacaggataggtaaaaacttcacttcctttcctcaaccaacctatagtcgctgagatatgcacaatctggtttatgaactgaaagggattactagcttgactagcaaactggatgaaactctcaagatcatctagattattagaaaagtagatattcaaacaaagatttataactttcttattatttttatattaccaagcaaaagcatcatcacaagaaatagaatttttcataataaaatacagcagctactcgaatcattgcacaatcattttatatttatctgtagggatttgatttttgattttaggatcatgtatggaaaacactagaagacttctagctagatcacggttactgtatgatggggctacgactacacaagctgaacaagaaaggtaaagcttcatttcttgctttcatcctctttcttggaggtaaatgcaaagataaaagctggtattaaaatctgatggagcaacaaagctaggaccataaacatactaatgtaagaaaagaaagtgttaccccctcttttataaatcgaagacaataactctatcataaggagatgaaaaagcaccataaattgcatgagacatatggccaaaaagtatttattttgaagaatttggtatccaaaggaccaaaagaaaaaaactatcatgtcagatcatgtccctaaaacaattaaacttctttgattcagcattagaaacttacagtaaactgagcatgaacaccttgaagattttcttgcttccatgtttcaggaaatacaagaggaaaagactttgattcaccttgttgaattccaattatagaatcaaggaaacctggtaatactttttcaccatcttctgtatcaaaattaaagcctgcatatccaatatagatttagaggaaatatgttcatgatgtactacaaaaagaaaaagacttgtatcgcttatcagtttattatcatccttcaagcacatcacccaacctttactttcagcagaaggaatacttttaacatttgattcatcttgatcaatggttgttgctgagatgtcgaggacaacaacatctccaacctgtgaacagcaaaaaaattgtagcagctggctaattttgggtagactagtcgaaattattaatacagatattaattatcaagataacaaaagtgtctgtatgacagttatttattagtatgagatagtaaagataacataaaaataatcagtaaatatccttcattgtatcagtcacaactaaatataaaacatacatgatgaaatctatatagtctgtgcttgctttaaagaacttggaagttttatgactaaaatgattcatgagagtttcaaatgaatagcatttctagtaaataatcattaaaaaaataaaaataaaaaagcaaatggttgtatgccagcagactggtataaattaaatttagtcacctgtagccctctgtcagtaaccactttcagtgcaccaatggacttataacgtcttctaaattcttgttcagatgctctgtgagcatctatatcactatctatctcaacaacaatctttaaatttttgtatgcattattatcgggaatccatttgatttctggtgcaatatcaacaaggacatcatatctggagattggagaagttaaataagtgagaatagttaatataatctgcctgtagaagtcgttggctttggctgacattctgacaatattagcattcttaatgatagtcttccttttctctatattatgtcagaatatagttttagtattacagatgcagcaaaggaagagaaaaataacgactctaatggaaaatatatttcaaaaagcttaacctatagattacctaagagacccaagagaagaatatgtctcctccatctcagaaaacttagtcactattcgtactgagtcctgcaaagcccttccagtaacctataaacaaagttaattaagaaatgctcaagtgtaagatcagaataatacttgatctaataatccactttattcagtaataaccttggagaaatgatcaggaaattataacgattttttttaatctgttgatcagtatcaagtcctcagatcaaaggcatttcagtggcacagattttaaataaatgcattattagatagcactgttaaatagacttaggtaacgaggaaaggtcatgaaccaataagcttgtctttcaataatgaagtaaaatttcaagatcagggaattattaacagatataattgcaagtaaacacaatgaatccaaaagtgtaaaaagaactaacatcaagagaaaaaaataaggacataaaaaataagaaaatagaaactatattgtaacataccgatgccatagcatgtgagagtgtcctcctcaatatagattcaatagtagccttctgaacattttgactcccaacataactaataagaatgctttctggaactttctttccagggcgaaatccagggatctgttgacttaaaacaatcgtaaattagctcataaagataacatgcagccctttggatgctgaaacctgggatccatgacaatctcaagtaaattcatatatgataggatagagcacatcccttaagattgtgaggtttagtaatccgaaattttcaatgagaggttttagttatagtttcaaatttagaaactgggaatcctcttgagtcttgacagacaaaataaagtgcaccgtattcacagacaacaataatttgatgcatatattttctttgagccagaatataagaaagacattacattatataattatataaagcataagtgtaaccccatagcacctttgcttgcttcataaactctgctatgaccctcttgtaacaatcctcacataccaatgatggcacgtccacatgcaatctaacctgcaaagggaaagagatgcaaaagtacatattcagtgatatgaattctggtccagaatatgtgctcacttgcttaccattatcttatttttaaggctttcttttgcaattgattaataatgcttgcatggaatttgaatcttctcctattgtttaagtaacaagatatggtcatgttgaagagaaaaatacaccttgcatatattttcacaattatcattaccctttataaattatatagcaaactacatatgattcacatatgattgttgagctgaaccaaactgagaaataaagataaaggaaaaaaaaaaaaaaagaacatactctggaattgggttccgctgtttcagtgaccttcaattctgctggaagacggtcctgttctgtgccaactgaaactgaagaagaagaagaagcagcagctgagagtgtgaagggagaagaagtgtgaggagagaggaagggttggaagaggtgaatatgaggcgaaaaagatgagagtttaagggaattgaatttgaagggtgttttagtgttggcattagcacgaagaagaagagagtttgaagaggaagaagggttgaaaagaaggaaatttctgaaggtttgagtgcacacctccattgtctctcagcactcacagcagacagacacaacacagagcatgttgatcggataaaagatagatattgtctttttaagtgtttattttaaaatcaaaatgtaacaatttcagtaattttctggtggtcccaagtttcagagtttacactttacagttatagaatgtgtcaactgtcggataaccatgcgaggaagtttttttagaagacaaaaagtaataagcacattaaaaattgtgtacattttctaatgaataatataataaaagatacaatatagttgaggttacgataacatatgatattaattttgttttttaaaaagttttatgttaatttgatcttgataaaaataaaaaaaaatatttttattggtaaatttcattagacactaataatatgtgattgacatatttatatttatacgtgtaacagatttttagcaagagcgttaactaaatatttgactttgataataagaaaggaatacattactctcttccattccaaaataattagtcttatattttaagtagatcaataaaaaataataaataattaaaagagaataataatttataaaattaaccttatattattattaattcatttataatttttattgtccattattaatattataaaggatataaataaaaataataataattaatattacattaaaaaattaaaataaaatttattttgaaacaaatttttattccaaattggtgttctacctcctacatttctcctaaattgagcataaagaccttttaacacgggctatcaaaactaatggttaatttcttctactcgtacggaacaatcaaacaaaagaagcatgcatctttttctttctttcttttttctttttttccactctttctatttttatgcattcaacaaaaaaaaaaaaaaaactctttctatttttattcttaccaaacatagaataaaaagtaatgagaatacgtacaaaagtaatcttatattattgtattatactatttgtttatctttcaaatatttaaactaggaacgttttctcctccgctaagatgaattagttaagtggcaagacattaattttgaatacattaaattaattgtccaagcagactgttcaatttttttttcgcctagctcttttatctcccttataaagtctaatgtactttttgaacaaaacaagattaagaaatattgtgttctttaaatttttaggatattttatgcctttatattgagttttttttctttaaaaaattcactttgagtttagatttatccgaacatggaattgatttaattaactattgttggatatatagatgagaaaatgttttctttttaaatactctacaacacgaagagttccttaaaacaagtatttcgattagattaatattttaaaatcctcctttaaaagtaacattgtctaagtaattgtccgaattattaaataaaatgttttttttataagcgaaaattattattagaagaaaggcaccagtgtacagaatatgagctacacgagtatcattacaacaaaatcctataccccgagaaggattccaccagcacagaagaagtactagtaattaaagatagagtgattataaatcattaaataaagtggtgttaagtgcttatataattaattatgtttatttttcatttaatagttttttaaaatattagaagaattatgatgaaaagatcatagaaaaagatatatcactgttgtctcaattaacattgaactcagtatctaacataaaccagtgaaatattattataaaccactagaaagaaaaatagtgaaacgcaatgacgcatgcggcatgcaggccatgcatgttggacttatttagtgagttagggatcccaagggaagttgtatgcatacgttttccatgttatcgttcactccggacgaggaggaggaggaggaagagcaggagcaggaggaaaagtgtaacctgaaaagcacggcttcatatatagtatgagtcctctctcaataccaaagaaaaacaaaaattcaggaaataagcttccatgcatacaccaaatcattgaaagttcaatcaggagaagaagtactaatgtgtcttggatgattcacatcttaggatcgtgtcggtgagcacattaaactatctatctatccatgtcattgagagtcctcacaatttggacccaatgacacagtcatcaggggcaggcgtgctctatcactaacctaataggtcgtcctgggtgcattcaggtgaagaatattgtttaaaagacttctcgctatgcgaaagaatattattaagaatatgttaatcaattcttttaacgcatgcaccttttctaagttaatagaattttctatattactaattaagaaagcagagtaaggagtacggatgatagaaaacttacttccgcagggaatgtcagcaccttctagggcttggcagcaggcttctgatggcggttcctttggcccaatgtgaatgtgtgacacaaacctgccacaattgaatgcaattgccctattatcaccgcattcaaatggtgtcggtggtgttcctaataatatgccttcagtttctgtttcagctgagatgccaccaagcaccaacattgcaaacactaagctccctctaattcccatcctcacacttaatttcaacttctttctaatccaaaatcaactttgctcacaaattggattgatgacagattattatgctaacaaccctacaattgacatcacgtatttatacaagaaacaaaaggaagccattttttaataaaataaaataacttgtggcgttaaccaactccaagtttatttccttatggttattaaaatgtgattaattaaaaagctgactttctttttaaccatacctgaaccgatacgtttcaatttgggattctttttactccctttctttctcaccttttcgacggccaattttttgaagaaaaaaaggtaacgtgataaaataacatattttattttagaataaattgtaataaagttactcgagaatacaaattatagcaatgtatagtagtcaaataaaaacatttcgtaacacattttactttttttcatcatgttggatttagaattaattctcatttatctactttatacagtgaaaaaaaagtttgtattcaactacaacgtttattttatacactatgaaaagttatgatattttagtattgtaaatttggatatgagtttctatagctctaatgaaaataatattttatatcaggtttcttattgtttctactgacaaatcaccaattattttgataattttttatttttaaatcaagatatttaattttttattctttagaataagtaattttggttcttccatcaaattgataattaattaaccatctaaagtcaaacattggttttgatgtgtcatattggtgtttaggtaatgtttatgtaaataattgacataataattatgagataagaaattaaataaaatgaaaaataaaaaagattttgacagaaattaaacttataaccttttattttaaatataagatattaaatcattaaaatatttattttatttagtttaattttataaacactatttcccatcattagttaagagatattaattttttgaattaaaacaatttaatatataaatatttttaattatattttaaatcattttatatattttaattttaattttaccaatttataactaaatttcataaattaatatataaattatttttcaaatttattttaatacaaattatttttactctaattatataaattgatataattacatcaattaatatgtaaatcatagaaatcacataaatttaatttaatatgtaaattatttttattttaattatatcaattagtaaaattttaatttttaattttttaggaaacttacatgttaatatttttattttaactatataaattatttagttaataattttttaataccaactatataaattaataaaattacataaattaataagtgaattatttataaaaattattttatataatttagaaaaattattagacttcatttttatatataaataatacaaattttattttaattataaaattaataaatttttaattatttaaatattattttaagtttacataaattttataaattacataaaataatttttttgaataatccatacattaatttgtgtaattgttttaaaattataattaataagaaatttttttatatatattataatttataatttatatgaaaataaattttattataaaaataaagacatatgaaattaaatgcataatgcatttaaatatttaaatattttattttaatttaaaaaattataattcaaaattagtagctctttattaattatacatgtaaaatttataaaattaattaaataaaacaaagtatttttaaatttcattgcttgatatttaaataagcaacaaaaaataaaaaaataaaaatcacagatttcaaatttcaaattataaagataccaaaattatatattaacctttattttattaaactcacattttaattaagacacccatgtttgaattttagttccttgcacgggcacggcatttggtttaaacttctttaattgagcttcgggttcaaaatatttctatattattttataatttatataaaataaatgctagttgacgtctatttaaagaattatcaatatatatatatatatatatatatatatacacacgatcatgaatgttgatatatattaaaataattttacatttacaaatatatatcttatatagcttactttatttaaatgtgtgtatgcaataaatattagtttttgtcaatatagttatgcattcaaaatgtgtaatatatatatatatatatatatatatatatatataaagtttttaaaagtaatttaaaagttcttatagcttttattaaacctttacggtcatcgctcgcatcaatgaatctctttcgatatcgtttgacaaatgactccataattaaccttaattatataacagcacaaaaatctacccattatttcccttgggtatacaaactaattaatttcataacaaacaaaaataaagaacttatctttctttacatactagttggtgtacttgggataatccttcttcatatgttaaccttttcactggtgcagcaaataaattcctcatcttactctttatatatatatatatatatatatatatatatatatatatatatatatatatatatatatatattacacatgtaactatatttattttttgaatgcataactatattgataaaaactaatatttcttgcatagacacatttaaataaagtaagctatataagatatatatatatatatatatatatatatatttgtaaatatataattatttgaatatatatcaacattcatgatcgatatcgtatgtatatatatatatatattgataattctttaaatagacgtcaactagcattttttatataaattataaaataatatagaaatatttagaacccaaatttatattttttttaatgagaacaatcttttaaaatatcctcaagtgtcttgtttctttttattttttgaatgatctagtttgattatagtgtcataagaaagaacgatctaatttgatctaccattacaaaaaaaaaatgacatgatttgatatatatagcattattaaaaaataaagttctgtttgagttttttataattagaatgagttaatttgtctaattccatgtaactgagaatcaattaattcctttcaaacattataatttatacataacttcacaagtaaccttacataaccttacatacacagtagcataagaatgtacctattattgtccttggatatacaaactaattaatttcataacaaacaaaagtaaagagttgacccttcttcacacgctagttgcaacccttcatatgtcaaccttttacatgtgcacaaataaatttctcatcttgctcttttatattttattcgaacgaaaacaacctttcacaatatcctaagtgtcttgcttcttttattttttgaatgacctaatttggttcagaatgtcataagaaaaaatgacctaatttgatctagcattacaaatgatataatttgatatagcaccatgaaaaataaagttttgtttgagtttttttttatatatagtttgaatgagtcaatttgtctaattccatgtaattgagaataacctcaactgattccttccaaacattataatttatatatgacttcacaagtaaccttacatacacaatagcacaagaatctacccattattgtccttgggtatacaaactaattaatttcataacaaacaaaagtaaagagttgattcttcttcacacactagttgttgtacttggggtaacccttcatatgtcaaccttttacatgtgcataaataaatttctcatcttgctcttttatattttattcgaacgaaaacaacctttcacaatatcctcagtgtcttgcttcttttattttttgaatgacctaatttgattcagaatgtcataagaaaaaatgacctaatttgatctagcattacaaatgatatgatttgatatagcaccatgaaaataaagtttttgtttgagtttttttatagtttgaatgagtcaatttgtctaatttcatgtaattgagaataacctcaactgattccttccaaacattataatttatacatgacttcacaagtaaccttacatacacggtagcacaagaatctatccgttattgtccttgggtatacaaactaattaatttcataacaaacaaaagtaaagagttgatccttcttcgcacactagttactgtacttggggcaacccttcatatgtcaaccttttacatgtgcacaaataaatttctcatcttgctcttttgtatttttttgaatgagaacaacctttcacaatatcttcaagtgtcttgcttcttttattttttgaatgaccttatttgattcagaatgtcataagaaaaaatgacctaatttgatctagcattacaaatgttatgatttgatatagcaccatgaaaaatgaaattctatttgagtttttcatagttagaatgagtcgatttgtctaatttcatacaattgagaacaatctcaattgattcctttcaaactataaaactatgacctccttattactctaatcccctatgcccctctttccaatccctatgcatgtcttgtcgaacattggttataaattgaacactattattcacaaaaacgaaattgtttaacggaatgaaatataagaaattcatataattgtaacttttcaaatttataaaaaattgatgtctactgggagcaattgcacaaagattttggagataacaactcatatggcacatacatactgaaatattttataggtatcatgcacataggagcatgcataacttcctttttgttgaattaatgtagatatcttttgcattgatgaaccaaaacattaaaaataatgctgacttagaaagtgtattcatggaggaaccaaaaaattaaagcaacaagtgaaaaggcccatgtgacatcaattcaaatggtcacaatctgttcatacatcaaaacattaagatttacctttcctagaaccacacagcaatcactgatcaagtatcgggtaggagcattatctgttgcatctactattatatcatatctaccaaattcacataattacaaagaaaaaaaaaatagtcagtggtaatataaaaaatgaaatgtaaaatgtaagtatagaagaaagaggcctcaagcaaaaagaaaaatcaatcttattatagaaattatacttgctgagaatttccaaagcgttggaagtccgcaaagcttcttcatgttccacaacttgaatagtggagttgatcctaatattcaaaatatcttagttccaagaacaatgatgatacaaatattacaataacaaacatttgaaaaagaaaatttctcatgggattttatttgcagtttgtcaacaaaaattgatgtgatgaatggttggtgaaaaagtaacctacgagcgacaagcagcagcagcagatttcactttcggcttaccaacatatgcgtccgtgtggataacctgaaataaagcaccaacttgtccaaattaataaaaatagtgaagttaattaaaaaaatcagtaaacgaattacacaaacacagaagcaagacacatattaacaccttgtactcgcaaaagtgcaaatgcccaaaggctgatgccagacacaaacacaacaattcacaatgtacgtgttgcaccggctatgccaaaagagggtgggaaggtaaaacagataatacaatacctgcctatgcatattattcagctcaactacgtcatggtcaataacacccaagcgccctgagtatagtttttaaaatgtaagtttcaagaagcatatagactgaggtattattacatattccttttgtcaagaaacatatataacatatatacctagacacaacaactaattagggtacctcatagctcttatcgtccatagtttccaatgccgcatcttctttcgttgatctattgacaccagtatcattcttcgtaagaagatctgagctggtctataaattaacacaacaagaacataattaggtgcccatatatataattaaggtaaaattacaattattaaatctaaggaaatatttaaatgtgagtttggctacatatatagtacatacatcaacatgaaggtcctctacactttgatgatcatcatcaatatcatcatcttcactctcctttctcttctgagcaaaatcaagctcgtccatgacaagtggtgtccttctaaacgacatgactggatcagaagaaaaattttacaggtattattacatattccttttgtcactcttggctttcttttgcttttttgttttttttatctttcttgtctttttatattttttatgaatgaatagccccataaatactgactaatattttgtttcttgaataccttgtttgtttcaaatccccattttatgtatagtcttgaaaatttggttgtactttgacgcattttggtttgtttaaaaaacaattttcaaaacttaatagattttagatgatatatacattgttgagtagtgtaatttttttattataaaaagagagaattaaacatgctcctaatttatttatttttagtttttttttttctcaatgaagaggtgcttctttgacctttgttgcccaccactcactaggatttttttttcttccaggaaatagtttcagcatacccttttatttcacctccaggcctgactcaagcacactcaaatcgagtgtgcaaagctcttgttcttcttcaggtccgctcacatatactttgtctggtctttttctccttttcttcaatgctttcttactaacacatatcttttgctctcatggatatcttacagtgtggcatctcaccccgatataaggatgggattcctccatggtaatgatatttttcttattcacctgaaggaccgtgaacttctgtttggtaaataatattatttatgataaatagtatctttgaaaatttggtcttcaactgagtcaaacggcattgcatgattcatgtatttttgtggttgatgttgttcccaaactttgcttttgtacggtatatgttcaatacatataaaatgattgttgatatcttatcatctcctagatatatttttcctttttttctcactaataaattttcttttgcatttatttaaaattgttataagatattgtaaaagcaaccaattgcaaccaatttaaaaataagaaataatttgttaaactataaaatttcataaaagatgattaaaattgttataagttttcttttgcatttatttctctcctatttcttttaccattcttttttttatcttattttcttttatttttattttattttctctttttcttctccttctccttcctctttttttctttttaactttcttgtatttatcattaagttcatctattatcaacttccaattaatttggattaaatgtaatggtcaaaagaccatacatacataatctaaaatgttttctgcctataaaacagaatcatgcagtcaatttttatgtgcaacttgctctctctctatcttatcataagacttctactttatcttacttgaaaatgaagtttctctctctttcaatttataggtcataccacttgttcttctttcttagcattcagtcatacttatattttttttactgccaatatactttcataagcatccatggacagaaacttttgggcaattgaaaggcatattagttgttcttttgttaatataaaattaaggagattgctttgacattaccatatccgtttcagcagggtttttgctcattgaaactaacactttaaggaaaaagatatgactctgttcactctttacacttacctttttctcatctgcagctcgtatacctctatatatgtatcccttgcttaatacaaccagtatggccaatccatttgagaatatgaggcttaccagtcttggagtcattggtgccttagtgaaggtactacgtccttgctgattctgttattgaatacactagactatgagaagaataattttttatacaacatttatgctgaacagagaataatttcaattagtaaattattgtcacaataaaccctgccataaaaaactaaatactacaataacctcaagtaatatgtcatttaaaaaacagtaataactgattattgattattataaatctgtggcacacaggtaaatgtgtaaatattttagttgccacaaataattagtcttgttataatcttataatgttcatgtagattttcaactatttgttaagtttcaaattcattcctgtaataattttctatgatgtaacaggtacatacaactcaacttgttcggattagttcatcgctagtatcagggaacaaaattttccgaactattttatgcccttcaagatattgttgattttttttcctagtgggatgaagctattgtttttttttttttctgttgcttgtcacatgtacatttatacttgagttttgtcatgtgtttaatttcctttctgttgatatttcaccagtttcataatacagcagctataagtttccttctttcaacagtttcttccgctttgcctgcatagtatgcaaataggcggtgaattgtcaaaaactgtaagtttactgatcttgttttaaaccaatttggttcgataaaatatttatttggatgaattaaacttgatttttatttgtttcatttttctgagttacattttttgggtatgtatgatgaacatgtatgcatgtgaagcatgttccaatacaatgctacataggaggtgtaaggcaattagcataccatttatctgatcaatgagattacaactgaggaaagtggtcttggcataagataaatggatactatgtgaacttggggagggatatcatttaagaactctctttttttcatcttttgaactgttggtcttaatataagttttttttagtggttatcacaggactgttgaaactcttcttgacatatttggttgtagaagagtgctagcaatactccttttaacattctattattggttgaaatttgttgaaaatcacaaattttggtaagttccacttttaaattaggacagagactcatcaaaccagaagtaaaaaccactattataattttcaataaatttaaactaataaaaaaaagaattttaagagattttaagagagtgttgcaaacattcctgttggttgtatcaaaatgcaactcgacaccagtatttgtagttacatgggttgaaataccccgtccttgatacttgagatctaaatctttaaataacacgtttgtttaactcttgcgttgtagttggtggtgcatcgtaaatgttaagccacgtgtttgtttttgccactatctcgtgatcctctttttatgctatcaaaataattgtaatgggaaaatttgtgtgtaatctaatggaagttccaccaactgcaggttggaacctttatagttgaacaaattctgtcggttgaaaatggtatgaaacatatttgtacttcagcagggcgcctttttcaagtatatatagttttcggaacgatggtggtaactcttgttcagcaaccttcatgtcgtcttttgaaggtcattattcgttgttatcttcgtctgtcagaaaatcagaggtttgttaagtagatagtaactccagttttataagtgcttctgcagttctgccaatgccctttacgttcttcccaagtttctaataaaactttggtcatttcaaaatagagcttgtcatgcattaagaacctgtcttccagccgtgttaagagaagctacattcagtagttgccttcgtgtaagtgatattattagtataaaaatttgatttaatcaataagattgaagtgagttgattaagtgaattgaagattaacaatagggcattaacttgtaaagctcgctctcttcaaatttccgagctaaagatttttctcctcttcttatgaagagattattcatggttttaggatgtttacatttttttatgattttggttttatttattcaggaacacccaacagctaggagatggctacagtagttgcttcataatattagagtcaatccggttcttgcacaacaaggtggaggaggatccgatcatatgacggggtcgtgagaacaagactttctggggtttctacatacataaaataggattttcagttgggcatgtatagagagaatgaagaattgaatgggaagggaactatctttccgtttgatgtagtgaaatatacatgagctgatgagcatagtcacctcttaattaaatgcaaatattaaaatcataatgagccatatatttcaaaaataaaaaacttctcttcatctatatggataaaggagattgttagagattaaatataatgagagtaaaataattattcatttttttcttttaaataatagcatgtaaattttgttccatgctattataatatatgcaaccaatagactggaaattttattccattatattccactttatctcattctatttcttttcatcaatccaaacaagtccaaaactcaccaagataagagtaaggaaccaatttgatcattcagttgaccaatagaagaatctcaatcaaaacccattgaaacctcgttgatcaaatcagacctaaacacacaatataaaacatccaagaacatacacacagccaatcatgaactaaaaatgagaaaatagattgaggttttaggatcttaggtaccaatgagtggtccagattcactctccatctaaacataaatttgagcttctagattttaaataattaaagaataggaaaaagtcaacccttcacaaattgacagatgtcgcaagaaggttcaaaattgatttcatatgaatctgaaaaaattgtccaagaagaaaaaaaaaaccttgatttcatatgccaagctgcactatggtctaaacaataagccaattacaacataagatggaagacaccaatttattattattagtaacaaatttaagtataatcaaatttatatatgtatatgaaattttagatagtgtcaaattttaagtaatattaaattttattttaaggtagtgtcaaattttatttttaatcataattaattatataagtatatataattattgataaaaatcccccactaaataactccaattttatttcaaattttatcttatatattgtgtcatgttgcgacaatatagctccgccacttatagttaaatttcaacaccattctctcctacagatatttaccatgctgtaagccccaaatcatcgaggaagcagcagagttttgtgcatccttcaccctagattcttcaaatgttagggatgaaaaatctagggtgaaggatgcacacaaaactttgcaagatccttttgagaaaaagaggaggcaacaaacaccttagcaacacttgcatgtccttcccttaattgttttatatcaacctgcttcgccttcttttggcacatcccatacaacatagtcactattggctccaaaacacccctcacaatcacaattattttcacaaaccaatttttcatcatcttgaatttatacaacaacttcaatgtaaaagtaaaagcttattataaaaatcatttataatagttgtcattcattttcatcataatgaattgattcagcattgcaaatgaaattaaaaaccttgcctgataatcaattataatacttatcattcttatcctatttttgatacaatattaaaaaatattatatactatatttgaatgcaatcttaaaaaatattttatcttattatgtaatgtaattttaaagatttctattatattatgtaatgcaatttctaaaatattttatcctattttttaatgtaatattaaaaaatattatatcctattatattatgtaatataatcttttttattattaaattacttttttaatttttaatatatataataaaatttatattaataaaatttgggggtggcccatcctaacctccctatctcctcccctttccgcaagtcactctcaccctgtctcacttcattccaagtccggtccttcccgattttcttttataaccaagtcaaattccttttagaagtgcgtgtttggataggtaggtcagtagacgggtcacaacatcttgctctcattgagtaggtgggtcacgacatcttggttgctctcattgagtaagtgggtcacgacatcttgctctcattgagtaggtgggacacgacatcttcttgctctcattgtatataactactcaagacatctttttgtagcaaaggcattaaaataaaaaataatagaacaatctaaagaaaaaaaatgataaaataatcaaggataacaagactaaaaattatcaataatatttttagaaagaatatttgtttgtcttaatcataactttttgaagcacaagcagggaaataaagccaagaacaaaccagagccagaagcaaaagcctaatatatatgtatatatatatatatatatatatgtgtgtgtgtgtgtatgcgggtatctatgcatgaacattacagcacgcgtcgaatatattgcctcaataatgtgttctttttttttttggatacaataataatatgattgaattttttaattgaaaaaatgaagtagacattcacttgtgcttgtgggatagtaatttattttccttttaggttgtttcattattatatcgaacaaagaagacgagttaagaatatatatatatatatataaagaccacttaatatatgtccttattaatatctttttatttatattaaaattacttcttaatttatttatgttttttatctgttatttttattaattttttcactcttttataagaaatgatacttttaattagtcttccaaatattttataaataataaatttatttaatatttaaaaatagaaaaaatatttaataaaaaaaactagaaaatcagtatgaagatgttacatgaaattataattaatttaaaaaaatgtgttttgctatctccttgtttaagaaattatatcatttcttcgtaataagtttttgtgcgtgtatcatattaaagttcgaacctagttacggctatgaccttatgtgtattatccaaatctgtcaccactagtctttgtaacaagtgtatcacatgatcttttgaaagaaattatttctttcttttgataaacttacaataagaaaatatgtaatttaaatatttagaacaaattcatatgtttagaatagatctaaaatgaaatagatgtatttagaaattagttgttttaaaagaattctccttaaatatacaatacacatcacattctatttttattttaaaattgaatcaattttgtaagtttaaaaaatacagggatttctcaatgggtaatgttatttcaatacctaaccaaagaacaactacattaccaatagaaaagatagtcgtcattactatagtggaattttggaatttattaacattatctaaaaaggatatcgttaataatcttataggtatggaaactattaaaagaacaccttattgagcactctacaaagcatttgaagtatgagaaagaaatattgttcagataatatttctaaggagttgcaaatggatcaatgagttccccaatcatggatggttctaaaacggctaagttcatgacaatactatctatagttattaaatataaaagattgttggaccatgcatgttctccgtaatgattatgactcatttccttagtcaatttagctcttaatataagatcattcaaaatatactttttattcgtgaaaattgataagtataaaaaaatttacgataactcaaagactctatttaatcaaatgaactaaacccctttacataaatcaataaaacatttgaaagatttgttttatcatttgtcctaacaaatgtaaattatcagcaaatatctaaatgatcattgttaaaagataaataaagataatttattaaaaattaaaatcatcatgtgactattaattaatttttaatcttaattatttaacattatatgactcaaatttatatattttattcttaaatgtttacactaaatatttccccttcaacctttttcatttcataacatattttttatatcattttttattattttttaatttccttttatatatccgtatcaatatttattttttcaattaacctcaactgattccttccaaacattataatttatacatgacttcacaagtaaccttacatacacggtagcacaagaatctacccgttattgtccttgggtatacaaactaattaattttataacaaacaaaagtaaagtgttgatccttcttcacacactgttgctctacttggggcaacccttatatgtcaaccttttacatgtgcacaaataaatttctcatcttgctcttttgtatttttttaatgagaacaaccttttacaatatcctcaagtgtcttgcttcttttattttttgaatgaccttatttgattcagagtgtcataagaaaaaatgacctaatttgatctagtattacaaatgttatgatttgatatagcaccatgaaaaatgaagttctatttgagtttttcataattagaatgagtcgatttgtctaatttcatataattgagaacaatctcaattgattcctttcaaactataaaactatgatctccttattactctaatccctatgcccctctttccaatccctatgcatgtcttgtcaaacattggttataaattgaacactctattattcacaaaaaaaattagtcccaataattatcacacaattactattacattgcatgaaattatttgattaaatttaatttatcattgaacagagtataatttgtatgaataataattttaagttaaatctatataaatttgatcaaattcacgtgcattacaaagtttactttgatattacatattttttcaattattccaaaaaaaacactaaataatttaattaaaccaggaggtcttaatacacaagtttatcgtttatgtgcaaacccataaaaattatgtgtatatcatcacttaacttacatgaccgcctaacagtccttggatgagagaaatatttcggaaattgtttttaacttcaaccctcaaatctttccgtacataaaggttgattaaaaaaataaaacttcaatcgtatgtactaatgaaccgcataatcaagaaaacaaataacgttgtcaacaatcacaaatctgtcatattctaattcgtaaatactttgatgtgccgtatattagccccaataaaaaaacgttaaacgtgtactgcatgttttgaaaattatcgacgattgtgcgatcaaccattgtcatttgtctgaatcataaatcccagaaaacaactttcatttctcaacgatccctaatagtaatatataaatttctcgctacgccatttgcaacgatgaccatcatttacctttcatagacaaattaataatatacgtactaccatttaatctttagatagtgaattccaatcaggcctaaagccttcactgttccttattatatatatatatatatatatatatatatatatatatatatatattagccggccaatactccatagctatggtgaatactatgaatataaatgtaataaaggtattaatacataaataagatgaagaagacggttacggaagaaaaatatcaagagaaaattgtgggtttcatttatttatttattgaaaatattagtgtttttttattttagaggttgaaattatttgtttttattttattaattgtaagtttataattggttgtgtgtaaggatatgagatgtaattgggtttgtgtccaagaatacatgaggtgaatatgatcaatttaacagtaaaaaaccctaccttttataatttaaccttaacaaaaataaacgcaataactatattttctccattactaattataagatgatttcaactaaattatattcattagaaaaagtagttaatcataataaatgtgtcaattatacttttattatcattttaaaatgattttttttcttatttttctatctacttaattatttcttattaatgtttggaaagagaataattaaatgaaaagtatgtaaagaaaaaataataaatatatcttgaaattagaaaaggatcttatgaaaatggacaaacaaatttttaaaaagtagcttataattaaagatgaaaggagtaattttaagaatattgaataaagtgataagaaaaaagaatcttggataaacaattaacctctttggttgttatttaatttattttcggttttatatatttaatatctattggtgcttatagaaattagggtgaagggttgcatgagcttagtctcggtatgcaaattgaaaagtactggagatgttggattaatacatgagaaaaaaaaaatcttttaataaataacttaaaaaatatttactatataacatgaatagctccttaaaacaaatatttcgataagttcaatattttaaaatactccatacattaacattctccgagtaattatctgaattatcaaatagaattgtattaagtattcaatttatttattcatataataatttaaaagaaaattaaaatcatgggatgatatatcactgctatctgaattaacattgagctcggtgtcatacataaaccagtgaaagatatttatttattgtaaaccgaaaaagaaaaacacaatatattggacgcaatgacgcatgcaggccatgtttggcattatttagttatttatggatcccaaggtaagggaagttgtatacttgtatgcatacgtcttcaatgttgacgttcacagcagacgagaagtagcagtgtaatctgaaaaacatggcttaatagtattagtcgtctcaataataataaaaaacaagaaattaggttgcatactgcaaagctttgaaaataagcagagaatattgttgtttatgatctgggtatatattataagaagtaaaaaaattataatatcatccgattaacataaattgtcgaaaatgattaaattattaatattataataattactttagaaattaaatatgtttatgggggagtacttaatttctttttgttgagcccgttaaaatttagatttaaatgcatttttatctcaaatatcataattgtgtgatttgatttctcaatttggacatgatatttgataatatgatgatgtgatgtgtgaaaatataaaaaaaaactgacaaaatgaaaaggataaagattataactctcaatcaaaattccaaaaaaaataatacttaccacaataaattaatagattttttcatatataaatgaaagttatataaatacaaatataccttcaataaaaatcaaaattgcacatatattacttatatatatatatatatatatatatataatttctagtattaacaataatatctttgattaatcttcttttgacatattcatatttgcatgcaatatatttctatttattaaattattaataaatttctaatacaatactaataataatagtattaattaatatatatatctgtattattattattattattattaatatatttagtatatataacctttctgtttagtaataataaatacatgtgcaaatttgatttcatttaaagtaactctcatctatatattagaaaattttattactttagtagtttggtattacgtactattggagcttagggttgaggataattctaagctcatcttggatattttgaaaaaaatgatcctcttatttttacatgtcatgttacaaattacgaacatataattaagcatttataacatcagcctcatatcaatttcaggcgttgtacatcatcggtatagttaaggatcaaaaatcgcaagaagtgcatatatactaataaagcctaaaaagttgtatgtatatttaaggtaaaatgtgttacgtgcatgaagtcaaatagctaggagagggtacgtgacatacatgcataagaattaaaggtgttgttagaagaatggttaaaaaattgaaaggaaaaatatttattaaaaagttcataaaagagcataaaaaatcataaaaatattttatacatttcaataaaaatatatttcttaaattcttgaactaatacagtaaagatattagtatttttgaagaattaattaagaaaagagggaaagatatatatacatacttccgcagcgggttccgggaggaactgattttccacaagacctgaggacatagacaattttttctccgctgaagtatgactgaaaattgccggcaatttggcacatgcaagggacatcaacatctttcagggtgttgcagcaggctgcagatggcggaatcattggcccttggggttcatagtacttctggcattcccgttgaatactaaaaaaaattaccattgcaagcttgacccgatatacgtggcacacctacaatgccagcaaccaccaacattatcgaaaaccctaatctaattccctgcatcctcacactcacactaaccacttcaatggaggattaattatatatgcttgcaattgtggagttgggatcacacactcatatatatagaagaaacagaagggagttattaaattctgattaattcaatatttgactttcttttaacccaaagctgaaaggatacgtttccttaccttttcctcggctaatctcatgaggaaaaaattaaaggtaattttaattaacgtgatattaaaaatctaatgggaaaaagagtatcatacgtctggtgtgggtctgtggttatatgtgtgtgtgtgtgagtgtgtaaaatgatcattacattacaaaaagaaaaactatatcgtaaatataaaatttatcgaatggaccaactaatcaaaaatcaatatttatatgatatttaaaataatattataaaattaataaatttataataatttatgtttaaataatactacctctagctaattcttattataaagtctaaattaaatcatttttaaaagatccaatctaatatgttacttgcattaattgtttttcacaaaatattcttaattaaaatcaatgcttgaatgatgtaaaagtgagaaaaaaaaaaaaatatatatatatatatatatatataaaactgattaatgtttgtaagtttttatcactagagaagttacaaaataatttaagagaaatttaacactctcaattaaattaactattttatataataattttttaactcgtatataagttaaaataattaattttatattaattaaaaaaatagtttacatcataaaaagagtcatcaaaaataaaattaaaattaaataaagaatgttttagaataataatattaaatataataaaattcattaaatttacttatatttaagtctattatataagataattttttgtttataaatgagtccatagtaagtactaattttattcttatttatatgattcaattatttaattcaccagaattaagaaaatatttaaattaactgatgtttatatttggattccttacacgtaggggcacggcattggtttaaattaattaattgagctcgggtccaattatttattcattaattttttctacctttttcacgtgcggtaaagtttgccatacgttttaactagttcaataattaaattactagttggtctttggactatttagaaatttttaagtaaatctctattattattctattttgttgatttattatttttcatcttaaaaaaggagctaagttaagaagaaacatgattatatatatatatatatatattattctattttgttgatttagtatattattattagtattattattattattattattattattattattattataatagtagtaaattaaatgtttaatgttaattgcctcattgatttttatttttttttataatttagatgaatgtgctctgttcgtcgtatcgtaccatcgtgttgatgaaagcacagactattttgcatatgcctaatgttagggtgcccatctataactagagtatgattttcagtagattattaaaagcatttcctactcaataacccaatttttttaatggacctattgccatataagatttaattaaaataattcaccaattttgactccaatgttatcattcaacttaaattcttaattatttagaacaagcctctaattaaccacacatcattattttctgttaagctccttatagttcatagttgcaagaacacacaaatggcagcgtatcaaataagaatagttctcattttaagaatttgaaaagtataaatatatattactcaaccaaatataaatggccaaaattataattcaatttgtggtcacaaaaccacttaaaaaatcatgtgcagtttttttaatcttcaccacttaaatatatatatatatatatatatatatatatatatatcaatatttggaatttttattttcataatatgaagtgttctcatctgatacatcctctctctttctatacataaaaggattaacggattttctctatttttttctctacatctataaatatatatacacaaatatacaagtttttaagaaaatatatgttagtctttataatgggtgaattatctttcatttatttatttaccaaaaaacttatgaaatggaggaaaagaaaacaagagagtcctaactaataaaaatacatatctagtgaaagaacttttatgaaaacatatcaagatatataaaaatggatcacaaatcacaattacacatgactattttagaaggtcacatgacttttttttatctatattttcatttcgattcatattaaaaagtgtttgtgagagtattttaaaaaacttataaaaatatcttccaattggtctaaaatatttcttaactttttttcataaacttttaaaataatttactagagtagcataggagcagcttattggaaggcacacctatgaatcatgttagacacatttatagaggcataaatgtattttttttatacatattatccttttttacatatttatttttcatgttaagcatcgatctttaaatgctgattttttttttgtttttatttgatttttcatatacttatattatttatttatacaagtgaattgtaaatttttaagctgattgatcatgattttactatatatacgattttaatttaacgtcttaatttatattttaatcatgttatgattattaaatatttgaattgttttaaaactactgataagtatatgattttttttaacacttatagcaaaaaataaaaacagattaatagcattcgcattgtaatcttgatgtggtttttctctttgttaaggatatcctctgacaaagcaaagacatagttatttaattacttgcttagttgatttcttaatttatattattttattcagtttttatgtccaccttatgtatattaaatttttttaaagaggtattataaatttattgattactatagattttgagtataggtaattaagatgataacattagtgttattgcatgattccataatcttatcattcaaagaattataacaaaatataattatatcttgtaagtaattggtaaagttatgatgatagcttgttaccaaaaaaatataaaacaaaatgaatcaggccatgagccatgtcaggtaaataaatgtaaaacccagaaaagaaaacccaacaaactgtgacttattttaaataaaacattataatactccaaaaatattttttaaataattcaaataattttagtaaattatcaatcaattaaatgattttgaatataattttgaaatagttacgacaaaaatcagcaattttatcatacacaattatttatgaattatgattaaatactattaagaaaattgtttcactcagtttttcttttgtaagtaaaaaaagttaaactaaaaaactataggaaaacacattaaaaaattatttaaaaatattttttaaataattcaaataattttagtaaattatcaatcaattaaatgattttgaatataattttgaaatagttacgacaaaaatcagcaattttatcatacacaattatttatgaattatgattaaatactattaagaaaattgtttcactcagtttttcttttgtaagtaaaaaaagttaaactaaaaaactataggaaaacacattaaatatttgcattataaaataataaatacgaatgccttgagatatttaattttatctgtagctttaaagtataatattatgaatatatgaatataatttaatgattagaaaatatttcgccttagttcaaggattagaatatatgcattcaaaaaaataatttaagaatgtttccttgaaattgaatattataaatatagtaaaatgtaacaaaatattccttatttaaggatcttgttaatgaataaagtaagaatattttcctgaatattatattttaagtaaaaagataaactcaaaaactcaaatatattttcttttttttgaatagtcaaacatctatctaaatgttattttcattgcttacatgataacataataaaaatttggattctaagtaataaatgctttgatattttatttatatgtttaaaatataatattataaaaaggataaatatatcggtgtaattttaaaagagtaaaatattttttaaaaaaaaaaacagatagatattttaatgatttaagccaaatcaaaagattttattattaagtatttgatttgccacaacttttttaaaaattactatatttttttttgaataatcaatttatatatatatatatatataatataaagcgtaagatcattttctattaacaatttgaatttcgtgtaacatttttagagttaaatcatcctcattttgatcccagcaatcttataaaaatcttagtaatttaatgataataatatatataatataacgcattaagtgtggaatattagcagcaagactataaaagaagacaacaccttggcaaccaagtgcctttcgattaaaactccctaccacagaatgaattctttagcactgtgttccctgttgctctccctttgcttgtttctcattgctcagtctccttccctaacaaatgctagagtgattggtgatggttccgacctaattgcccaaatttgcaatgaaaacccacagaacaaggattgaatgcacgaatattctaagagcagatcctaaagtcctgggtgcaaaaaattttcttgaacttgcagaggcaatcttggagttgggattgaagaagggaatagagggtgaaaactttcttaagggattggaacatgttcccgccattgtaagatgtgaaaattactatgaaagtacggttgaatcgtttaggaattctttgattaagttgaaagacgatcctctaattgctaactatttggccaaaattgctggtgatggacctttgtcatgtgaggaatccttgggtgctgcacatattgttaaccgtgcaatttctactcttgaccaccaaacaaatttgcttagctatattgcatttctagccacagagagacttagttaggcagcaccttcaatctaaggtctcttagtggtttagcatgttctttgttggagagtaattaataaaaatcaaattcaagttttctgctatttgtttgtggggtacgtacgtgtctagctaccaccattatcttttcttgtctatgtacaacattttgtttattgagatatataggtttagtagtgttttttataatttccaattttatctggttaataaaaaataaacataaaaaatgaaataaaagaagttaaaaagaggaatatgtcattgaatttaaacctattaatggtgattagtcgagttttccaagatggtcatcaataatatacaccataccaatgattaaaaaaatgattagtcacgtgtttttttgtcttatttgcctttgatcaattttttgtaacgctgcactaccgaagaacaccatgagcaaacaccatctcacaacttccatgcatgttgactcattctttttctctatttaattggttcttttgatacccaatgctttatcacttgtctatttatctgttgttttgctatatagctttgtttgtggtggattgattataaccctttttccctgttggaatgatgcaattgatataaatttattatcaattaaatatatgttatgcaattagcataaaaaataggctataagttgacagtttaaaatacttttatgaactttatgagctatattgatcttatttacctcaattactatcatacagtggtcaaaccctactcaaccacggccaataagtcacttgcttttcagaagcagtgctttgcatcagtccccaaatcagctaccaccaaattggcttgtatatgatcatatagtattccctaaatattatacttagcaaatcagctcatataacaaaatgcattataaaccgagtgaaataaataccaaatattaactctaattgtctacacacttgataccttttgaatcgtatgaactcaattggcattcttcactaaaattcccaaaccaactcagagatgaaccacagataatggtaagcaatctcgaaggcgtcgggttcccattaggaatattaaatactcttaaactctagcatcagccaatctcaaacagagcctaaactcttcgtctgaagtgttatgggtaaatctttagctacaactccaaccactttttttattatgaattgtcctacttttactttctgttgcatcgtaaagaattaaaaatgttcaatctatggaaggtatctaacaactaaagacatatcatttaaacaaataaataaatttaacataagaatagagtaggacaacagaatagctgaacattaacttttatttatatcttagttgagcatacagagcttattgatgagagatcacccaactaagcttagccttacagaaaatctctaagttaggaaacatatatttctaggaaatggttggtaaattgtcgatccaactatccttattaacgtaagaagctaaagaaaattctttgagttgtaacttatttaatttcttcatccacttaacacgctttgaagtatcagcccctggtcctttgcaatcaacttcagcataagtgaagttactcctacaagaatttgtttaaaaaataagacaaaatgacaaatatggttcaaaaaaattatgaatattacttttaatgtatcctttaagagataatatatttatttaaacttactcatggccagtataattccaagcgttccatccttgaggagttaccagagaggaaaaatatgttccatgaaatatgactctggagtaaggacgccaagctcttcctaaattcaccttcccatccccaaaaagggaacctccttcaaatacaaaaccacttggatcatcttgtgactttcgtccttgagctgtaacaaaacctggtccagtcctatttattccaacagcattgatcgagcaattctataagtggaaaaaaaaaattaaaaatattttattatttcatgtttaaaatgatttattttgaaaaagtatatttatgtaattacctcgtaaaatgattgtccataaccaaagataaaatccacttctccttcaatgtaacaatctttgaaataatgacgtccccttgcgtcaaataaggtgtcttgataaccaatgaaattacatctaaagaagaaggatttgtctccatatattcttgctgccaatgcttgtctaatattaattttacggtttcttctcctattcatgttgttatatgtgttctgcagttaaataaaaatacattagaaagaagaagaagaaaataatagtgaaaagttattaaaatgttttttctatcatttgttatgtaccatgaaaccaatgttagtcacaaccacattagttggccatgaagtgaatgtagcgctagtgtccattactttgtagtcccagaaagttatgattgttgtctggctgccctctccttctaaaatgatgcagggcttttcttggggaatataaatctttcctctgcacaattagaatatgggaataacaatatacatttggaaaggcgagtatatttctaaaatgcgatccaaattcaagaaaaaagtacacatgaaaaaaatccaaacaatatgggtattgtcttcatattagtagaaagaaagaaaaatacccagccaaatttgaaaagaaacatgataggcttagaacatgaaaggagccataaaatcaaccaatgactagttaagaaagttctttttctaggcaattagtttgttgaacatgcatacattcagaattatatgtctggtgtgtgtatgtggatttcttgaagctcttttagtaggaggagtcatttgtagcaaactaagatgaattaagagtaatcttaattgttataaatgattatgaaataaaccaagtattgctgttgaaaaatggaagaaggtagtatgatgttactacataaacgaagttgtattttcctgaagtttcagccatgaagaagctgaaatggactctagtgaatgaaaactgctgataaattgattttgatcaatgcctttttagcagaaaagaaaaggaattggtcctgttttggtccaagatcagaaattctaaaaaaaaaatggtcagccaaaaaaaggtgttttatttaaagggtaccaaaggcaagtacatgttgtataattagtagaactaaagcccccctgcagtggtatttgccctgcattccaaacaatacccacaatttcacgtaactatttctcttctcctttgcccctacccgagactatgttgttgctgcaccattgtgtataaatacatgtattccacaaggatgcatcacacaaaccatcagataccagataattagtagttcatatttgtaaacgttgcaaataagtaaattgtgaactaacttgatgccccctttttgactttccgcaagacattaaattgtttcattgtttttagttgttaagtaaatttccgatagatatgttgtctgcctattgtatgagtactattcttgtatgatttaaatcttgaatgcttccttattaagtaaatataacttatagttaagtgggcttgctttaattgcatttgttcatgtattcatctgtgttgtatgatttatatatacaagctttaacatctaaaggaatttgtaccaccatttcatggagcttgagattatgtagcatgtagtagcattatacataatgatattggcttactgatgttatgtgatattgattatgaaatggattaggaaatacagtttggttcatttttttattaaaaaaaaaaaaaaaaaacagaaccatgcacacgtctagactaaacattaaacaatactttggaaagaacaaaccaatacttaataataacatttcaattcaacttacgtgtataagccagcttgcatatgaatcttgacccaccgatcattgttgtttcttatcgaaccaattgcagcttgaattgatccgaatgttacgttgccatgcccaccaacagttatggtgtatgaaatgtccttcccgccacaatctattttaccaagaaaaaaaaaaaaagttaataaaccaacaagaaaaacaatatactttggaaaattgaattgcttttgtaataaatagtaataaattacaaggaagttggttgcttctgtaatttatgtgaaacaaatttaatcttatgtttgtttgaacgaagaacgagaaaaaattacaaaatttgaattgaaagggggaaaaaattaatagagaaatcttgaaattttgtttctttttattaaaacatattattattttttccttttttccccctctttatgtgaacttaacatagtataaaccataggtaatagacatcacattacatctaaatgaaaagttttgaaccaaatttaacaaactgattttttttttactttctcatttctaaaacaattttgaaaataaaattacgaaacagattttatatttttacagttgatttacaaaatagtttttaagaactaaaaagaaaaacaaaataataacttttatagtaaaaaaaatgaatatcagtgtgttgcttcttttgttcggatcagaaagtgtgctaagctttgaacgaagaaagaatggatggattatcgtaattaagaaagtaactttattaattattacttgaaagtataaatcttattaattaagctatactagtaaaaaaaatgtcagccaagggaaattcattaaagaggtaccgaaaggaatcagaccaagcaattggtttgtgcacttcatagtccccttctcgcatatatgagatatcagatatacatataaactccccatcaaagctaaccaactatgaacaatgacatacagttcataataaaagacttctacaaaaacgttcctaccaacatgaattctctactgagtccctgccaaggtttgtgttgctagctatatccaaatatatatatatatatatatatatatatatatatagcattccaaatccgagatgtgtttccacgtacaagtctttttaccaacccatcaaacaaattagtgctgattaatccaatcatacgtcacgcccaggacttcaattgtaccatatatatcccaaaccaagtaaatacatgaaagaagaacatgcatggatcatacctccacttcgagctgatatcatatgcatgccaccaaacaatggcattattgccaacaccaagcacccagggatgatgatattcatgactccaaataaaactttaaactttggttcaaaatgaaacttgagaggttaattcgttcaaaagaattgcaaagatataaggggatgatgagaggggaaaagagttctcataaaaaatgtacgttagtttatggcatatgtcaacaccagtgattcttaaaatgttattgattaacatttttagaaaaagctgagcataccttatagtagtaattcttttattaacgttacggtccatacacggtatataattcctataactttgggtaatgatgtcccacttttgacaacgatacggtagatacctatgtctatgtatattcttaacaacgccggtgtatattctacttgtgagaaaaaatcctgcatgaacaattttgctagaagtgcatacatttccaaagttggctccatgccccttgttttgagtttgttaccttccggtttctgctctcgtgagtcatatacattctactaatggcaatggaaaacacggaaatttttcatccagcttccttcaattaattaacatattgcttcattaattagagatgtaaaatttgatgctggccggttaggatccgtgactaagtttctcttctttttttcctgttttgtcctctattctccttggtggtttatggtacaccacaaataatgatcattagattgatctcatgtccacaaaactatgatgcaccctctgcatcaatgcaccaacgttcttcctctcctcagtgtcatatagtttgagactcaaaactgcagaggatctgaatttttggtgtcaaccaagtttccagaatgttagcttgttcaaaaaaaaaaaaaaaaaaaaaacttgttcattatttataattccaagtttcgaacgataaacccttttccatcttttgaattacttcaatctcaacgtgtttggtggcgtaaatggaaattcagagaccgtaagaaacacctcctagtttggacgatgcagtggcgaaaacgtcttggtcgttttgggcttgtcggaggaggtgcattataacttctcatacaactaggaagtttaacggtccatattataaacaaaatatatgatcaccataagtcacttattctactactctaccttagcatcagtattgtacaaattgtctaggccatgtaaaaaaagaagtaagagaatatgatttacttcttgtttgactttctcatgtaatcttataaattaattttttatcttttaaattttgttcaatttgattcttcccttaatttataactattttgttaataattctaagataatgaataaggatggcaatgaaatccgttctagtggattctcgttccgactttgacaattaatacctaagttgatcggatacgggttcgaggattatccgacttttttaatcaaggttggggttagagatgagaatgtcactatcagcctggtagtcatatttatacccgtcaatcagtttatttttttgtagacaaatgtcctataatgaatttattgataaataagtagttaaaataaatatgtaacaatgaatttattttttctaaaataagatttttaatatattttttacaaaaaatattttacaaatctgaaccatagatggggcaggaacatggatacttgacacccaacgggtacaaaaatgagaaatcaaattttaacatgtcaaatatcgataacaagtacgaagataagttggaaagtcgagaactcaggagacaataaccttccccgcccgatccaattgtcatgtctaataatgaaatatgtcacaaaataaaatttattggcttggacgtgtttcttcaagtgtaattaatatagtgataaattttaatatatatatatatatatatagcaattattttgagaatgacgtgtttaaaaaaatcttcttttattataaagtaaatagattatgatgttatgtgtgaaaatattaaaaaattgataaataaatacaaatataccttaaaaaaaatcaaaattgtgtgtgcgcgcatatatatatatatatatatataatttatagtattaataataatatcttttattaatcttcttttgacgtatttatatttgcattcaatatattaatatttattaaattattaataaatttctaatataatactgataataatagtattaatatatatctgtaatattattaatattaatatatatatatatatgtcaatatttgtaatttttattttcataatacgaagtggtttcatttgatatatcctctttctctttatatataatggactatgatttttctatttatttttctctacatctataaatatatatacaagtttttaagaatatatatatatatatatatatatatatatatatatatatatattagtctttataatgggtgtattatcttccttttatttatttatcaaaaaacttatgaaatggagaaaaagaaaataagagaattctaactcatataaaatgacatatcaagtgagataacttttattataacgtatcaagatatataaaaatagatcacaattacacataactattttaaaagttcacaagacttattgatctatatttcatttacgatagcttataaacaaattatttagattcatattataaatttttgtgagagtatttaaaaaaaaaacttataaaaatatatatctttcaactgctctaagatacttttaacttttttttcataaactcttaaaataacttacaagagtagcatatgtgtagcttattggaaggcacactggtgaatcatgttaggcacatttatagaggcataaatgtattttttatacatatttatcattttatacatatttatttttcgcgttaagcatctttaaatgatgaaattttttttgtttttatttagcctttcatatactttttatttatacatgtgaattgtatatttttaagcttattgatcattaaatatatatcatgttagacacatttttatttagcctttcatatactatatatatgattttaattttaacatcttaatttatattttaatttaattatgttatgattattaaatatctgaattgttttaaaactactgaaagctatatgattttttaacacagagtaaagaataaaagcaaactaataacattcgcagagtaatcttgatgtgatttttctcttggttaaggatatcctctgaagaagacatagttatatacttgcttccttattttatattattttatttagtttttatttcaaccttaattatttatattaaaaaaatttaaagaggtattatagatttgttaattactatagattttgagtataggtaattaagatgataacatattagtgttattgcagggatagctatcattcaaagaattataacaaaatataatgatatcttgtaagaaattggtaaagttgtttaacaaacagaattttttttactttctcatttctaaaacaattttcaaaataaaattacaaaacagattttatttttttataattgatttacaaaatagtttttaaaaactaaaaagaaaaacgaaacaatatcttttataataaaaaaatgaataccagtgtgttgcttcttttgtttgtgcacttcatagtccccttcccacatgagatgtcagatatacatataaactccccattaaagctaacaaactatgaataattacatacagttcataataaaagacgttcctaccaacacgaattctctactgagtccctgccaaggtttgtttgtgtttctatatccaaatatatatatgtgtgtgtgtgtcaaacactagtgtataattcttaaaatgttattgattaacattttaagaaaaagctgaacataccttatagtagtaattcttttattaacgttacggtccattataattcctaaaactttgggcaatgatgtcccacttttgccccagtaatttaatgattagaaagtatttccttatttaaaggattagaaattatgcattcaaaaaaaaaaattaagaatatttccttgaatatttataaatatagttaaatgtaacaaaatatttcttatttaaggatattgttgatgagtaaagtaagaatattttcctgaatattatatttttaagtaaaaagataagccaaatatactctctttttttaatattcaaacatctatctaaatctcattttaattgcttacatgataacacaataaatatttggattctaagtaataaatgcattagatatatataatatagataaaacgtaagatcattttctattaacaatttgaatttggtgtaacatttttagagttaaatcatcgtcattttgaatttttgatcccatcaatctgataaaaatcttaataatttattgattataatatatatgataaaacgcattaattgtggaatgttagcagcaagactataaaagaagacaacaccttggaaacttaatttactccacaccgactgcaaccaagtgccctttgattaaaacaactccctaccacaaaatgaattctttagtactgtgttccctattgctcaccctttgtttcttcctcattgctcagtctccttcgctaacaaatgctagagatcttcataatggttacgtcctaattgcccaaaccccaaatttgcaatgaaaaccaaccgaacaagattgcatgcacgaatcttctaagagcagatcctaaagtcctgggtgcaacaaattttcttgaacttgcagaggcaatcttggagttgggctggaagaagggaatagagggtgaacagtttcttatggtattggggacgacaaaagatgttcccgccgccattgcaaggtgtgcaatttactatggaagtacggttgattcgtttaggaattctttgagtaagttgaaagacgatcctcgaattgctgactatttggccaaaattgctggtgatggacctaaatcatgtgaggaaggcttgcgttctgcacatattgttaaccgtgcaatttcggctcttgaccgccaaacaaatttgcttagctatattgcatctctagccacagatagacttattaaggcatagttgcaccttcaatctaaaatgtcttactggtttaattagcatcttctttgttggagagagtaattaataaaaatcaaaatcaagttttctgctatttgtttttggggtacgtaagtgtttaccattatcttttcttgagaaagttttaagtagacatgatgagtgtctagttcgagttttatgattgagagaagagaaatttattaaaggtgataagttaatttttttgacaaagatgatcatcaataaaataatttatatcaatatcatgattacaaaaataaatcatgaagtttaatggtaatgaaatgataatacaaaatactctaaccaatatcaaagaaaaatattacttccaactgcttaaaaaaattgttgaagctctcacctcaattagatagtagtttaatggtaatgaaatgataatacaaaatagttttttttttatgtatttcaaggtaatcttataaaagttaacaaacttatcatttagatttaatttgactttttatcttttaaattttgttcgatttgattcttccctcaacttagaactatgttgttaataattctaagataatgaatagacatggcaatgaaacccatagccgaaggtaccagccttgactttgacaaggaatacttgagttgatcaggtaccggttcaggtttaaagattattcgacttttttaatcgaggtcgggtcaaggatggagatgttactatccgcctcatactgatacccatacttgctaatcagtttatttttgtagacaaatgttctttaatgaatttattgatatataagtagttaaaaataaatgtgtaacaatcaatttattttttctaaaatcagatttttaatataattttttacaaaaaaaaaaaaatcacaaatctgaaccggacacaaaaatacccgatatctaacatatacgagaatgagataacaaatttcaacccatcgaatataggagacgcatacgagatatgttgggatagtcggagtcggaaattgagtagccaatattcatcatccctaccttgtccgttgccatgtttgataatgaaatgtcacaaaaaaaattggcttggacgtgtttatgcaagtgtaattaatataataataaattttaatatataaatattatatatatatatataccaattattcacataatggcgtgtttaaaaatcatcttctttgattataaagtaaatagattatgaattgtttactgaatattataaattctttgaaatttaagccagtatataagactatcacatgaaaattctggattttgggattcatttctactgatccgttagatgtcaaacatgtgaattggaataacagtcatacgctaaacatttcaattagggcaggataaaatttggtcgtcaagcgtcacataatttgtatggggagatgagatccgtttaaatcgatataagaattgatagtttcacatcatttaataaatttttattggataagtattttacaaaatacaccgttagattgaaagcttatattatatagatcacatgtctcaaatttcatattaatccgaaatcatttgatacctaattgatatatataaaattaacataatatatacttctaaaatatgtgaaaattagactatttgattacatttctattgatgtttaaattttgtgaaatttgaaaatgtgatttatatgatataaactttcaatctaactatggattttgtaaaatacttattcaataaaaagttattaaatagtgtaaaactatcaattcttacacaggtataaactgatcacatctcttgtatggttgttgttggttgttattctaaaggctaaaatatgtttgatacgttttccattcctataaaattattaaaatttatttaactttgtacaaaaaaaattattttttatcctcgcaaattaaaaatatgatattttgaatcgaaactaaatttaattatgttcaaatttacgtgttgatgactaaacacataaaacctagtaaccaataagacgttgacatatgtttaaatccaatatgtgattcaacaccaaatctccccttccctccctcgtgctcttctccccatgactccgacaatgacacataaaacctagtcatgctcactttgcaatccaaccaactctgaaatttcaaatttttttggagacactcacttacgttctcgccttcgagacgctatattctctcatctctgcgattcaagttccggtttgggggatagggatctgggagttagaggtggtggttgttttagttcgaggtgtggcggtgacggtggtttaaggtgcagaggttatagcttattcttacaaaaaaaaaattataatttgtgacaatttttttaatagtcacaagtttttattttttctgcaatttctagtgggtttaaaaatccgctaaaattgtatattaaaatttaaattaaataaaataccacacggattagaattcgccaaaacctagctctagataaaaagtcacattttaattttgcaagaaccaaaaaagggacaaaaattttaaaggaacaaaaacaaactttgataattttaggtgaacgaaaaatatattttactctaatataaaataatagactcacggaaaaaaattcatgctaacctgaccaaataaaaaattctatattagtattaaaataaaatttaaacaaataatgaaaggttcaaaaatgtcagataatatattttacggttgtaccattcattttcttatgccctttttgacgacaaatatttgtaagtaataacttactttcaaagttccatttcacacattttgaaagtgccccactcagctatcttttccattattctcttcatcctcgattgcgtgggttacaccaacttccgctggccgaataacacgatcataaagcatatatcctgcctgcaaacacaatcataagatacccttttattcatgttttcaatctcctaaataatctgcccaacaaaagtaagaataagaccacattccttcaagaaaagtatcagatgattgggttaaaaaaacataaaagctttgtcataaacactgacaaagatcaaccagtacttgacgcactgcaaatctatagataattaaccaaactgtgttgcatatccaacacgattcaatatgatatgcaagagaaatgtttgcaaaacaccttttattattaggtgagttgcactcgagtcccactaaataaagtagggaccagagttattttaatgacaccaacatgaaacaaatcgaataaagcatgttaaaaaagtgttgctagctcctccaataagcaaataggaatattttaaaacaaaataaaatacattatggtaatatatattgaataaatatttgtatatctgtaactaaattaaatttattcagttgttattctttgtgatgattcttaggatggtaagatagcaagagtgagaagtgctttgctggaaggtgaagggtgagaagttgagagcatgacctggatttgaatctcagtagaaaagatatagtaacaacaaaaatacgaattcaatattgttggatatggctcatctttcgcagtcagatgacaacccttcttgttggcggggtcagcagaaagccaactggggtcccgctcttttctgtttttcgaattgtgtgtgattgtcgatttccaacaaatattaccataaaagtaacagtgttgaatatgaatatgatatagatatgccaccaattttcaagtaaccatgcatcatagacaaaaagagcatatcaagagttttgagtgtcaaaacaaattttaaaattggaaaaattgaatcacagtccttccactgtatattaccttcagaacagctgcaacagttcctggaggcttagaaccatcggggatttggaagatggcattatgcctgtgtggatcaaagggctcgtttgtaggatcaaacttttctacaccaaacttttttagtacctgtaaaccgaagcaattagttttacaataggctgaagcctgaagcactttactgtccaaggaagcatattatttcaagcatacaataatatattgtatagtaaaatgaggagtggcaccacactctctaacacactcttattgataaaaatttattgaaaactacaaaatcatgaatgagattcattaaatatggagtggaacccaaacatttttgtgatttccgacaaattaaagccaatataagactgttagaaagagtgtacttctcatagtaaaatataactggaaaaaacttttgtagtatgattataagttgagtttgaaacatgaaggaactaaagtccttccccaaattccccagttcccaacacacccatcaattcatcaaaattcaaaaggtaaactaaatatccaatttacaatcaagccactgtaaatcaagtgctttcagtacaaaataattattctttttttaaaataacaattcataaaatagttatgagaaattggaataagaaaataatttccaacatgttcatgatttaaaaaaaaaaaaaaaacatcatttaacacagaaaaaaaaacaagccccacctaatctcacagcacctgaacaaccatgtcctcaaacttttgcataaagcctctactcctagtccctccaaatcacttttaccgtaccctcacattcactcaattaaccatcaatcgactatcattactaaacaaaactatataaatgaggaatttagatagctgaaaagaaatggggattaaaacttaaatataaaaatgagtagaaagaaaatattgataatagattagctatgacttttgaaattaaacagataaaacaaaaagtataacattctacctctgataattgtttctcagtcatttcaacaccttgtagaagtgttttcaggagtttcaccgcttcagcagagtcaccagccgtatcaatttttgaaaatttttcctttgcaactgaggaagctcttcccaaattgtccgcaacatccagtaaactctttgcaaaattctacagcatatttaaaccactcagaacacagttgaaggggaaatcatttgggacaaaagggatcaaagttggacctgtaaagcaaatttttttgaattatctgcttcacgtctagtcctttccatgacattctccatctctgcataagtacgcagaactttatcctgcattttttcaatctccttgtgctttaaggtcacaagttcttccttttcaaccacaagtttaattaaatcatccctggataagtcactttcactctctgaatctgaatcagaaaatgcagtccgtttaaaacctctcctccttcttttgacagtttgagattgagaatctgaaatagaacctgattcctctgttttatctgcaggtttatcttgtttagcctgatcattattctttgcctcttcatttacttttgcagggtcatcatttgtagaatcttcattatgcacattatttcctttttccttgtcattattttcggttgaagctgatgaagaaaacccaaatcttggagctaataatgaatctattggtggcagcaacaaattgatttgaacaggaatcacctggaacattagaaagcatgagaattttaaaatacatcaccaaaattcattagataaaaataattgaatcctagagaataggctaatgatagtcaccaatcaccatataatcatatttcatagtatcatatactacatcagaagaacaaaaaaatttggggaacctattgttccttcgtacacacaaggaatttaaaacaccggtaatccttaggaaaaatattttaaaaaaatgacagcgaacaagaatgagaatggggatagaatttagaagacaggacaggacataacatagtaagataaaagctcaggcacaatgttctttatcaagagaaaaaagttatactcatatttcatcgaccacttttttcattaaatacttatttccacacaagagaaaacactttttataacatttttttctcttttaatgtaataaaacacaacacacctgataaaaccctggcaaaaatggacaatcaaagtgaacagcagaaaaatgacagaagacatttcatcctgatattgtttttctaaaccctaaaatgacataaataaaatttctgaacatttgaattcaaaaccaatagctaaaacagataaattagcatcaaaagaggtacaaaagcaacaattaggggtaacactctataatgcaacctattccaaactgcataaattacgaatttctgatacacaatctgtcatgatccctaattaaaaaaaaaaaaaaatcatcactgaaaattctaggcaccttagttcaaaagttaatatattattcaaaaatacagctgaattcaaaaatcaatgaacagaatccaatcgaatgaaatagcgaaacggctaaaacagtcaaattaaaaagcaacctccttaaaccctggcaaaaccctaaaaccaaaaaaagaggggaaatcaaaggattttgggaaagtgtggaagagcaccttgttgggtgaatggggaagaagggaatgtaagttaatattggagagggtggacaagtgttggggtgtttgcgaagcagagaggagagaggttcggaaaatggtggtggaaacacgggacaaaaccctatgaacgaacatcgttgaggacgaagaagaagaaaagttgtcgaataacagaacagaacagagtgtttatgcaaaaacagagaaaagagaacagcaaagtctgtgctcgcggtggagagagaaaaacataaattggtgaggttatttattcattataaacgacgtcgcctctaagcaatacatctccaaattttaactggagtctgggaggattgttaacagcacacttttctttaattaacacctattcatatctctcgctgcatagccattaaatttattattattgtttaagatttattgaaaatgaataaataaaaaataatctcaataacattctaaacaagatgggataaaaaaattggttaacaaattttcatgggaggacaatcaaattttaaaaaaaaacgattgaataattttttttataatgatcactattttaaaaagaaataatacatataacatacttaacgaaaattctctaaagagattgacaaaattaggaattaaattttatttataaaaatatagaattatttaagattatttgttttaggaggattatttattttttaagcaacggcacttgttatgaatatcatctatgttaaacaattactctgcttacccttttttctaccatgcatcgtaatcgtaatggcaggtaaatattttaataaaatcctaaatttacacaaccaaaccaaattatatcatgactaatagtaatagctacattttatccaacaacgatagaaagcaaaagttcaaaacaatagaatagagtgtttgtagtgaataagtgtatcaggaacatagcatagcatgggccatgggcatggctttcactagagccgaaaatgtttttcctaaaagaagaagatgactaacaagctgcagcactccattgttcttcaaattgaacatgttggcacctccgaaatcatggattccatgtcacgctccttggaaaatttaaaggtgctacaatcaccaacacgaaaagctttgttgcatttgggtccggatcctctcttatttacgtaacctggatagtcccatctaaaaaatggcactttctcaaccaagaataactctgcttcctctgccagtgtcactacttctcagttattaaaagggtgagcattcttcggtgtcatgtgaatttctccatcttggcttaccatctatcttccttgcactcttcaaaaaccccgacaccacgtgcttctgaagcctaagttaaatagaaatacgtttagaacgtgtgtatataaaacattttatgttttcaatatttggtgtagtagtattgttcttcctataaacttactcaatctggcacggatcatgttccctataaacaaaaccagcatgtggaaaattgaagacagtgcgatcaaaatatttccttcggagcagcgggtgtttgttcatggtatgaacatccacttcatgcacaatggtgtaaccaaggttctccaatttgttttaagtttgttgaagccctggactggagtactaccctattaatgtcactaattaaagattcatcgtttaactagaaaaaatggttagaatcaatccacaaacacataacaaacgcagtggtttctaaatgagataataatgtgtctcaccaactattaatgactcacccataattttatgttgttttctataaattgagtcaaatctcatgagataacctacagttttaaaaaattattagaaattatgttagagtttgtttggatataatgttataagtgcttgagagtttatttgttgaaaaaaaaatattttcaatagaaaaattttcaaaaacacttgtaacttgtatctaagtagacacttactacttgtttcttttatatatttcagttatgacaaaaaaaaattgccagtaatagactttcatacccgttttagttgaaatttattagaatatactaagttttactccatgtatgaaaagtttcatacaaagaatgtttgccagcatttttcgaaaataatgcttattagttgaaaaacactcggtaatagtatttagtaatggtttagatgaaattgtttaatccgaactctgatgattatgggtccactctattcctacattatttcctacattattcttgcagcagctcgggtgagttagaagggaataagaatacatgaaagttgacatcatccatggttttaacaaaacccaaaaagtctattttaaccaaattcgacttgtaggtagttgtgtcatttggccactcggtacatacataaaatgagtatatgcagcaacggattatttcaatatttcaattaggtgaccaaaatatcccaaggtcatcatttcaaattagtgaactgactaacggaggtactctcacatatcaggtttaattagaaaaattaggtactaatccaagattcaaacttaccaaagcaatacatttccttgacgactagaccaacctgttaatcattatatttagctacactaaacacaacgggcttgatgcaaacaagtaattgtgttttgtctttattttctgtcttgacacttgattgtagatgacaaaatattcataaatacaaaaacatatattgaattataaaacttcctactagaaaagaacggcgacgcatggtacataaagatctcatgacgcacatgcattgcataaagaccccgtaaaatttgtatgctacaaatgtcactaactaatctaattatagcactgactcaattgctcagaaatttaatcatagggattcctaaaattcttcaagagattgggaatgtcgtaagctaacatgtcatcaactgcttgtatcatttttggtttcaatttttcaaacttatcaatattgtaaccactcaatctctctctgaaaaactctacatttggaaaatcgccaggaggtaaatggaactccctttgtacctgtttcaaagttgtcagtcatgtgtatacattttaagtgttgtcagagacaagcagataagcaaaacggatgtacacagattcatacctttccaaattcagctgccaaattatcgatgagcttttgttgagctttagctttgcccatcatagcaggcatctcctttttaagatgactgataatgtaagcatgtatcttggctgctcgggcccgttttacaaactcattgatctataacagtcaatatatacaaatgataaattaattatgcaaaaaagtaactttaacaatttaaatataaactggacactgaaattgaagatacgagatagtcacctacaaaaaacacctgtagaatttataccataggaaaggagactattgtatcaaacttgtgtgtggagtgcggatgacactaaaagctgataacattagttttcttaatttttaatttcacaaaagaaaaaacaatctaatcgatacgctggctttcttgtagtttcactaaaaaacaatctaatgacactaaaaaactattgtatataagggtagttttttaaactcttttcaaaactaataactcttttttaggtccatctttaagttgtttcaattttttactttcagtttgtattactaatgttctttcttgcactttcacattttccccactctttctgaaaattagttcttgaaaaatgttttataaaatagtttttaaaaactaaaccaaaaacacaaccaaacacacccaaagtaacctcattttagtggaaaactattcttatgataaagaaaataaatttagttaaataactcactcactcttcgatcacaagctgcttttggtacatctttcagatccgagagaagatcatcctgttccttttcaaagagttccttcccaagtggaccagtggcagcatcatttacaggtttgtcattgaaggagcttccataaagaaggttaattatgagcaaatgagcacatggcaatctcataaacaaggaaataaatatacagttatattatgtctaattgcatagcaaatggggaaggcggtgtggaagagatcttccactgagagtggagaaacaaagcagtctctcccccaccctccataacaaagacaacacttgaacattgagtggagacatacccaatatacactcgcattacttcaggtgtcttcagcaccttcccaagtgaccacattaaggctccataaaccctcatcaactgcaacagagagcccaatataggttaagatttcaccggactaggttgtgaaagattcaaaagataaacaaacagaagtttgactacacaagctcttacttgttgagtatcaacttggtctgccttgttcaaaactactcggattttgtcatcatgcccccgtaaggatgatatcacacgattgaactcatcactgatgtccagtttgtgaggatcaaacagaaggagtatcaaatcacacttagcagcaaaccaagatgttacacccgtaaaatcatatgctcgttgtgtacgttgcttttctccagatagaactccaggagtgtcaacaaatgtgatgtgttccagtagctttggacaattgaaagagtcaattctaaatgctataaagggaaatctcgtaaactttttgaacagatctagatcaacttacaggatgaggcatttgtgaacacacaaattttgacaaaaatgctgtgccaaaagttgtaagaccactaaatggcatgtctgcttggacagcaacagtatttccgggaacgcttctctcatcagatccagactgtacatcagcatcctttgctagttaaagtataaaactaatgcaataactcattttcaagatgactactagattaaaggattattaagaaaataatttaaaccatcaactcttggcactaatgctatggtacgaactactgagttccattgccaagttttagaattttcatgttatgaagaatagacacacaaacacagggcgatgtcctaaacatgtgtgagcatgagcgtttgcatgtcaaatggaattaaaaaagattaacatcacaaaatatctaaattgagaatctgaatttatattcaccctctcaaaataacttgttaagctttacttatgccctactataatgagccccacacaaaaaaaaatattaagaagcatcattttacattttccctaaagaagtttctttagcattttgtatcttttaaatagtttatattattctttatattttaagttgatttctgaaagttaaaacattttttcaaatttataaaatagccttgtcttttgaagtctcaagcgatatttaggtgtcagttgacagagttgaatgaccaaaccatgttaacgcatgtccaagccatcaacaaaaaattaattaaacaccagtttagtagcgtccaacacatgtcatacaaatgttaaagaagtgctagtgttggaacttggaagtatgactgacactctgacactgcaagaaatagcagtgttgatgcttcatagcttccaccaagatgttagtcttgccagcaattagaagtcaaattgatttattagtttaaaactaagaaaacattgaaggtaatagagagtcgtgggagataaattgatttggcttacacataccatgacaacaacaaacctatcagttgttggttcaggcccaatatgtgctcctatcaacatttatgggaaaaacaagacaaagattaataacattattttaaaaaatatgttatatcaccctattaatcatcctaaaattttacaaagaatattaaataaaataaataaatgtatttaaaattatttcttcataaaacagaaataagcaatgtgagaaatacatatatggatatagtgaaaggagaatcacgtgcctggataactacttttaagcagatgtttgataaatgttgttttaccagttgagtactgacccaaaagcataaccattggtttggcatcaaagtcactgtttgtctacaatatgaaaagaattacaatcaataacaaaattaattgtatatctttgtagatatttaaaacatagtgacaacatgagtgcataaagaaaggtagagtagctagtcatttctaaacaaaataacttactgaccagtaatggggatacaaaatcattaaaacggtaagtaacttctaatggcttcaacttctgaatgtagagtctcttcaagccgtcaattattgatgtcacagaggaaagaggcacctatgaacatatgtaccacaaatacaagtaaaaacacaacaaaaataatatttgacaattttaaaaaactggcaataataaagaggtaacaaatacagataaaaggtcctagagaacatatctataggatgacctttagggtaacattaacttgattcatataacattagagacaaaattagatatttagattgacacgagacaaaatgcacattttgttaagtcaaaaagaagaaattagataataccaattctagattgacacaacaatattcacatgtgtagtatcaggcacattactattattggctaataatatcagttacacatgcattgaaattaaataataaggttggtttcaggcccgaaataattacttaaacacatttgtttcatcatcttataaaagacagagaacaacataaccagaagtttctcacatatactctgcaagatcaaaagaaaacactaaacgaaaccagaacaacctaaagccagtaaagaatgacaatcaagttggccattacccattagttgaaaacttgaaatgaattctagtggactggaaggtaaggataatgcacatgaaatcaatcaaagtaacagtaacagaatgcttgccttttttgttgactttgaagaaaaccaattacttgacggcgatggctgcaattgagagctacctgcattattgctaactactgaacttagatttttagaagaaaagaacaaataaaataaaataaaatcaatatgaatgaccatatttagtaaaacgagaaatatattaccatttgcatcaacctctttttgtttatgctttttcttctgggtaaatacgtcaaatggtcagaactttcactaaataagcataaaaatgttaacactgtaaaaaaaatggaccttaaaaagaaatacttacagctagtagtacgtccaaaccctccattgagggaggtttcacatttgtaaaatcaactgaaataaaagttaagcttccattaggttaaatttataagaagacattcacaatcaaatcaaaatatgtaagcaggcacaacaacaagaatgtgctacaattataagaagttattcaaacaaagtaatagaagacaaacctaaacatacattacttaccatcactagtcagcagatcgggtgttattgagtgcccagattgagccaaagaaactagctacacttcagatgtgtaagattttggaaatttatcagcattgaagttcaaaaaaagcataacatatttttacctgcatagcaatgataaattcagtgaaacctagatatccttgtcgctttgaatctgcaatagcccacaccttattttggtaacagaagcaaacaaagaagcactttagttagcaagaaagaaagaagccaacagagatacttataagcaaggacaacaaattatattaacaacacaagtacacaaccattaaatgcccaaaccatttcagttgttatagataatacaataccaaaggcaacttctacatgagatatattgtaagagttcaaaattagtccattatcagtataaaataaacaatatcaggaaaccataaagtgtcacatcataagtgtaataaaaaaatatttcatttgcaaaaatagttgacaatatttgacaatatgcttcaataacaggataaaattctctataccaacaatgcatcagatttgaatctgaattgcaaaaatcaaaaccaatgtagctactggataatataagaagcattccccaaatcaaaggacaacccgattcaagaccagcaactaagtttgactcggcaaagtgaaattgaagagggatttaagataggaaggatagaggaagttcacagttcactagtgcatgcttgatagcaaaggcagagaagggaacaaataaaaaatgaaagtaaacaacattttgttttatattgtttgaaatgaatgagataataaatgaacattaaaccaaaattggccaatttgtaaaaccatagaatcccagtgttatctctttctacaattgcatgtacacttcaatttcacctcactttatttatttatttatatattttggcagagacaacagacatccttcatgtaaggtagtcctgattgagctagatagaattactatcggcagaaaatttaacatgaatatttaatgcaattgaatagtcaggactcaaatttgagaacactaattaagttggaaacaaccatatgtcaattgattcaggcaatcagtggttcacctcactaacgaggaaaaccaataaaaaggaaaaggtaggccatgttaataatgcccaacttttatcacttttaacttcatcccctaaccaagcaatcatatcttagaattttggcacgtcattccgattacctccaactcctatctgcattcattcagtacaatacaaaagaacgacaataaagaaagaaaatgaaaaaaaaaaaaaaaacgggaaaacagaaaacctgcttaagatcttcgcgggacaaattggacatggcgaaaaacttggtggcatcactccctgtaatgcggccatcgctatctgaaaaacgaagtgcacggtgaaatttttggatatgaacaggaacagaccatataaaattggaacaaaaaaaaaatactggaagatgaagtatgctgtgctgtacctgaatcagcgcaactgaaccactccttatagatcgtctggtgttctttggagcacgaaccgattgggatcgggtcgaactccattggtcgcagaaaatcttcggaatcgcgtgtttgagatctcgtagtgtttgagatgctgcgtttgaacgctttttaccttctcagggaacagaaaacgtgagcgttaaacgacaacgaggacttgcattagcggtgtcgtattggcgatggaaactaacgagacagagttggcgcagaaatgctgctttaacgattcctgtttttgtttaccaaaaaatagtgccaagttagtgaagttgggagtttcatctgaatgcgccaaattacgccttgtcgcgcacttcgcactcactcacctttgcttgctgattcagattgtcatgttaacttcacgttaatatggaaattcgtgtcaccactctattcttcgttttattttttttattttaatccatattgttaatattttttatattaatttgactattttgaggataattcttttaattggtacccatttctatcttctgacttttttttataaatcatcttttatctcataaaaaaacttctaaggtgacaccactctattcttcgttttttttatttaatactctacaaaaaattaaaattatttccttatattttgtatacacgcgcttaacatcatcataaacaaggtaagattatttttatgaaaaaaaaaatatagcgtaagattctattatataaataatagtaagaaattatattgaagttgtttggagaattggatgctaaacgaaccgaatctcccaaggaacctctttagtctttacccttttgtcaacctttgatttttacttaattgacctaggaaaatttcttaattgacctatcttgatttgctgacacatgtccttaacttgttagatatataaataataaaaagagaaaaagaataaaggttgcttgctttggtttggttgatttcattatcgaatattattattgaaaaagaagaaatttgttgatggattactacgggttttgtgactaactagttttggtttgcttgattgaagatcaaggaaggaagcaagatgttgggtgttataaggcacaaggtgctgtctgtgtctgtgtctgtctgtgtctgaagtctgattcctattccaattacatttcatatgatttattttatttgcagagtattcgccctgccttctccgcagtcagacacttctcttctgcatctaaagaggtatgcattattgttctcatctctaatctcttaatctcttactatcaaatatcaaactcgccagtgttgtttcgatgcagattactgtcagggaggctctcaactccgcactcgatgaggaaatgtcagctgatcctaaagtgttcttgatgggtgaagaggttggggaatatcagggtgcatacaaggttggttaattagtttagttgtcttgccaacctcaccttttaagaacttcattaacttaacttccttctttcattttagatatccaaggggctgctccaaaagtatggccctgagagggttcttgatactccaatcactgaggtcgtttttcttacttcatactttatttgcatctcttcacttgatttattaatggtgatggctttgggatgcattcctttgaactgtgttgttcttcatgcttagcagctgcttctaactttccataatagattgcttattgaacgccaaaatttactttttttcagcttctcactttaaaattgataggaaaataagaacaggatttatttatagttggttgcagctgttggattgacttttttttttttgtgaaatataatacaggctgggtttgctgggattggagttggcgctgcttactatggtctaaggcctgttgtggagtttatgacttttaacttctccatgcaggtttggagtttatcttgattgcatcctttctttcttaaattgagtgtgaacttaagtgatatatttttttacaacagcgccacttaatttatgtatatgtacaatgttatgtaaagtttactgtccaagaagatattagatggcattgtatgagtcttatcttctgtgtgataagataccagggttatgagattttcaacacatgatgattcattccacaaggaaaaatgttgacttccctgtgaggctgtgttgataatcacagttatgaatcaaggatatagatgtgtgtggccaaccctagaaatgctttagcatgatagcaactattttgaagattatgtatacaagataaatgagataattaatttacagttgatacataaatggtcaaaaataaaaattactcggtgaaaaacatttagtcattgataatcaaaagttatagtgatatagtctagacatacaatcatcacaaattacaaatgttaggcataattaacaagctaataacaacaaaggatcataaggatataaaaagtacagtgccaaaccttaataagtttgagcctctaaggtgttggaggaataatgccatgtggactatgaagtgctagctacacgacacaaaaggagaaaaagtaaaaaacaactaaacaaaacagagggggtctccaagggctcactgaggtgacaggatgggagttgctatgtagaacaccagcgggttgctggaaaatgacagcaaacaacggaaaatggcgaacctcaaactagagagtggaggggatgtgatggaaaacaatgcatggcagtaaatggcatgctgctgggtcctttggccagaagaaaatgatgaagctcaagctagaggggaggcatggtggatatgacaatgtaaatcagccgggcacatgacgaaattcccaatagtggtagtgatttgacacgttttgggcttgtgatgtctgctctatcaaaatccaatgtgattctctgtgcattgtggggacaacaaacaaaatggtgtgaatttctgtgattaccctgttattaaagatataaaactaaggatttgtggttgggattcagtttattgttaacagagacaaccattcttggcttaaaaaataaagcaattttgtggtgtttaactattagtttgaacatcacattgatgccagacaaatcaatctagtttggtagacgccaggcaggcctttttgctggaattttgttacttgtcaactcctattgcttctatgttcaagtattattcttaagtatgaattatgttggaagatgaaatctctttcttctggatgaagtaagcctttatgtttacaatcttaatattgagctttggtagcttgaatgttgaaatactaataaactgtgaagaatattgtgtgaacatgtgtaatggtgtttattttgggcttcatttgtttgatatacagctgcatcatcttgatttattagctagcagattaattgttcagttttaacctttgttgcaggcaatagatcatattattaactctgccgcaaaatcaaactacatgtctgctgggaaaatatccgtacctattgtctttagaggacccaatggtgctgctgctggggttggtgctcagcattctcaagtacggttctcctagctgttttcttttaaagacaaactttatttaaccatttgagaactgataaataattcaggtttcgtctttgtatgcccaacaactttgcctttatgcagtgttatgcatcttggtatggttcatgccctgggttgaaagtcttgtcaccatattcatctgaagatgctcgtggtttgcttaaagctgctataagggaccctgatcctgttgttttccttgaaaatgaattgttgtaagttgtgctgcttgattctcccgccccaaaaaagacacttgtgctgcttgatctgtacatgaaaatgagtagtcatagattttgacatcagttcttgtttcaaaaaatatttaacttgatgaattatgtcctctagatatggtgagtcattccctgtttcggccgaagttcttgattccagtttttgccttcccataggaaaagcaaaggtagttaattatctgtagtatattaaataccccttatgatttttggagccatatttactacacaataatacattcttattgacttcttgtttgcttcatgcattttaccactaaacagattgagagggaaggaaaagatgtgactattacagtctattcaaaaatggttggctatgctctcaaggtttgtttactgttagatccttttgtattatgaatatgtaacatgtattatgtgctgtttacttgtttgttcaatttgctgcaaagtatgtgaaagatataggtttgtcttgcatttaatttaaatattaaataataagataagacaagaatcgattataactttttttctggatgggttggtgtgttatgtggtgttttataatttgttttaaaaaaaattgaaatctctgacccctttaagtagagaacattcttaaatatatcttctattggtgtttaggctgctgagacactggcaaaggaaggaatcagtgctgaggtaaaactttagtttataatgaacttccccccttttctgcaaaaacatcatttgggttatgataatggtgcgtgatgttcttatccacataggtcattaatttgcgttcaatccggccgcttgatcgatccacaatcaatacttctgtcaggaaaaccaacaggctggtgacagttgaagaagggtttcctcagcatggcgttggcgctgaaatctggtttatctctttacattaatttgtttttgtatgaatgtatcttactggttaactcttggcaatcatacgagtgtgtacttctcttgcacagcacatctgtcattgaggagagttttggttatcttgatgcaccagttgagagaattgccggggctgatgttcccatgccttatgcagcaaatctggaaagaatggctgtcccacaggtaatggttcttaaatattaattagtttctgtgactggaagatttgttttcactattttgatcctgtaatgtatttctattttgaatgggtgaaatgccctgacttgatggttttgtaagagatgagttttgtatcctgataaatagctagatgctaatttgttcaaggttttggtacatgtctatccttcatttaaatttgattgcttcctggtatatgtggatgtacaggttgaagatattgttcgtgctgcaaagagagcatgctacagatccgtgcctttggctgcatctgcttgaatgttctggaaatttttcatgtcctggtcagttctttgcagaaacaaaaaatttccctaatttcctctataaaactgcaggaagaaattgcaaccaaagaatgttggttttaactaatttattatgttattggtttaaaagattctgtcgtatgcataatactgtcctaattttcaggactcacagatgctatacatattttccccatctcagcttatgtgggaggaagttaatgttaaataacttggacaacaatgacacaaggcagcaggaagttttcaatgtttttggtttctgcttggcaataactaaaagtcaactttttgaatacgttatttccagcggaccactatagtgcaagatctaacttgctgttagtttatcttcgtttactgttttagttatattggcaaactagagatattttatttgatgtgaggtctgtattcttgaggttgtgggtatttggttttgtgttaataatgtgttgtgtcctctacttcttggtgtatgtaagactctgtaaacctctaaacttcttttatactaggcgttgtttcagttagaccccacgtaattattgtattggccgatgttaatgtcaattggatcgtagaaagcgcagaaaattagactagaaccttacatttttcccttttacacttaccagatttagtttttcaattatctgaatccattgccagagtttgagtctaattttgatccttgtttaaagttttttttcaccgtgaatcgtgtgttgacaaatcacttagagaggtcttttaaaatactagttgttatagtcttatagacaacttcatttgataatgtgtgggtgtattgtcaggggaagataatttagcaaaatttaaattgaaaacctattttcatattttgatactccgaaacaaaatatatgccactaacattagcaattccaatttgttgtccatagtacatttgagtggtagggttttggaggacaaagatagtggaaattttttcatttctactaaatgttatatgatttgataaatctttaaaaataaaaggaaatgatatatgggtataattttaatgctattatttttttttattcttataaatattgtattaatttctgaactttgaaacaaaaaattatcttttttttttctccacccataacttttctattatctttttgtttgatgttttagaagaagaaaatgttccattttgatcatttaattaatgaagcatgaagtatttttttcactgttatattcttaacatttttatttttaaacggtttattttctacagaaatagctaaaattgtgaaatctcaattgtcccaagcatgctcttaagttttgtttggaaaaagtagttgaaacttaaaaattaattgatagatgaaagttgatagttaaaagttggtaaactaatttattaatagtcaaaagtctaacttctccgtcataatacccctaccgtcttccatcctctctcagactattttttcctctccatttttaattgtaatcaaattaattatgatacaaattaatatcataaattgaattgattattgttaataaaggtaattcatataattaatctggttatgctggtaacttgtatccaattaattcaattttaattaaaataaagatactaattactattaaaaaagataaattatatcacaattaatttgcttgctttaaaaaaggtaattgcatttaaaatcaatttaaaattcataaaaatttcacaattaaaacatatttttgttgtataaaaagaggtataaaaaaagtacaaaaacatgattttattaacaaaatacataatggaaacatgtttctattgcgtattttttacactcccttttacacaatgaaaacatgattcagttgtattattttttgagtgaaaaaatacacaatggaattatgatttcgttgtgttatttgggggtaaaaaaaatgcataatgaaatcatgattttgttgtgttatttagggatgaaaatttatacaacggaatcatgtgttcgttgtacaaatatacaatgaaatcatgttttcattgtgctttgatttttaaccccatataagcaataaaatcacgatttccttgtgtttctatcaaaagaaaattttcaggatattgctaaaaggcacccacataggtagtgctaataataaaaatgtagtgtcaatagtaactctcttaaacaaaagatcataaagaataacacttatttattgctataaagttgaaaagtatcgacatgaagtaacctcgaaagagaaagatgaacgagcaaagtttgattaatgatatttttttcggtttgttttttagaattgccaacaatacccacttttttatccttgttgcttaaaatttattggaatttattaaattctgaaaaaaaaaatagtagtgagagtcactccattacatgaattttaattagataacatgttggtagtattttttagaatttttttttttttaaattgaagcacttgaatctccagagctcaagaagtctctcctctttgcttgttattgctccctcacaacagaaacactatgttcaaataagaacaatatttgttcccagattattgaaataatttcttattattgtttaaggaaattattgaatgagcctagcaaaatttaaaatatataccaaaatattataattcctaaggtcatttattcaatttatttgcattgaaaagattaatttacaaacctaggtaaataaagatgtaaagaagtgctttgagtaattattactatttcttatatatgacaagttggagttgttaattttctaagagttagataatatccttatgtactttttctctcatgtattcatgtcataaattcttttttttttgtttcaatttatgacataagttttctctgtttttccatattaaattaaactatttacaccttttcaattaattattcattaaaagaaaaaaattaatgcggatttttttaattaacataagacacaacgttatatttacatatcatcactaaaatatttcctttacaattattattttatttcaaattaaaagtttaaaatatctgcatcttttatatttaattatttttattaaactaaaataatattgatcaattacactattatttcagatcaaattatatccatttaactttaataactattatattatttttataatttaatataaaatatgatttttattgatccaattattgaattatatctatatattattaaaattgtatgtgtcaaattttattaaaattgatcaacaaaaacatattcttaagtgctttgagtaattttataattatttaaatttaaattttatatatatatataaaataatatttaaattacactattatttttaattttataattatttttattaaactaaaaaataatatttatcaattacactattattttcataaatatatatgaggagatcaaattatatccatttaactttaataactattatatcatttttgtaatttaatataaaatataatttttattgatccaattgttgaattatatctatatattattaaaattgtatgtgtcaaattttatcaaaattaaacaataaaaacatatcatttttaaaaataatataataattataaaaattataccgatataattttatcctctcattcatatatatatacacacacacacatgtatatcactcgtatttaaggacaccttgtgatgtatgaaggagatacttactagttgctaaaaatttgtggtgcataatatttgaatatcaattgggtagtatctcagttccataatatattgttatttttcgtgtctccattgtctattgcatttttattctttttttataagcaactacgatgccttaaaaaataccgaatgagttaagggatataacttatttggttgagtattttataaatctcttatagtgtcttcgacgatattttgaatgttgattgttttcatagctgtttttttttttttttttgttctgaggtggactttgattcacattcagtgtttgttatgtggaagcatgtcacgggcttcaaaatcctttgtggggcaagttaatcggcccacttagtttttcttttttctttttctttaagtaaagagcatataatgcgaatggaggccatgatgtgctgcggaccctgccagcggcaactcccctaatttgaaggtaagacaatactagagcaaacgaggcacatacatagttgagaaaaatgccccccaaccaagacgtggtccaaaccctaaacacttcctattaacaaattttgatacctaccctacctttgagttgcctctaatcacaattcttggtctttcagaacatgattcccatcaccaaatctattctttatttccttcttttgatttgggaaaatattagtgcatctaagcctagtcatgttatttacttatttaaaaagaaaatcgtagtcatccgagataatttcatatacaaatattaattaatgagcaattgagcatacaatcacacaacattaaacaaacggataaaaaaaaacatagcattaaacaagagaaatttgacagatatagcacaagttacttttctttttatggcttgagcgttacagaatgattttcaacccaaatttaaggagaattttttgtatgatttgggatcatcataggtcaattttcacacaaccaagattctcaattaaaaataataataaaacttgattatatgttttttttgtgagtcataagcttgattatatgtctcacataacattgggatgagaatagtccaaaatgatgtaataaattctcaattttaatggctggaggtgaaacaagttaataattaaagggagaagaacaatttgttgggaacttattactaagatctcaccaattgatgtttctctacaagaagttgtgtggcgttactcaatcccatagagagagatatgacgtatgagtatgattactagacaaggaaataataagtggtaaggtgaggggcacctaggtggccatgcaggaatggttggttaggctgcaacattacattaggcctccattgaattctcaagggtcactttacacggtgagtgcgtgtttaagctggcgttgacttttcacaaatctctaacattgcaccttattttatgctatgcttgatgcttcttcaaaacaaaaacaagacacaacctaccatccccgcggcttctagaagtgtcacgttcatttcattaagtggggtaggaatatgcaaagaaacccctattttctctcttgccaaacaccccttcctacaacacatcacaacacaaggtggcctaatgcttcatcattcaaacttctaacaccgtattccactatccttttgataccaaggaagaacgaaaatattatatatttttcaactaaaaaaaaaaaaaacatcatagtacctatgttttcttagccctattattttactcgtaacgttagattgggctctaaaacttaaccatatgcagggctagacaaaaacagaaacagaaacattaacggtgacatttagattgcattgattcttttcttacacaacctaaattactacgttacaagataccacaaaagaagaagaaaaaaagaaacgatttttctccagtccaaatccaatcattcacacctagatctaaataacccacgctgccaaacagcttgagtgccatcggaggcaaaatgatagtagtagttcttttcctgttgcaattgctcccaaaataagaaaaggtaaaaacaaataatcactccactcaccaaacaaagtttctttgaaagcgctcttgcttacacttggtcataaaggtaaggaagaaaataaaaataatcaaaactacaataaaaagccttttggtaccggaaaagctgcatttgctttgcctcatcatgtaacaatttacatgaaatcaatcaaattcaatttggcgttacattcaaacattggaaattcagctaatgaaggcaaaaagaaccaaaccaaaaaataacgaattgattttccaagtgtagaggaaaaatagtaaagagaaataactaaatctaagtgttagagcaacactgaatttcttaactatgataaattgatgcatagaaacaaagagaagaggatcggagattacatacatacccacattggattacccacaaattcatcttgcttttcaaacaaccagatcataattactttctctttttttcttcccattcaatatttcctttcaaataaaatgatttaaaaaataaatagtaaaaagaagaaaataatatacccaacacggaatctgcctctcacagaattaagatcatattaccataatcttacatctgatcatcattttttaatatattttttttccgcatagcaataacaaaaaaatcaagttgaagagataaaaaaaaaatgagaaattaaaaatcatcatcgcacgataatcatcagagacaaagcgcggtgcagcgtagatcatcacccgcggcggcagcatcatcatcaaacggcagcgcgttgagatcgaacggcaagggaggtcgaaacgacgaggaaacgatgttgtcgtcaccgtcgtcaacgacggaggaggaagagtcgcagtcactgtggcagtcttcggggacaagagggggagtgcgcgggtatctccgcgtagtggtcaaaaacggcgacgtagtggttgtggtgggagggcggggcccactgaaggactcaacggtgctactcatgccacttgaagttggtctctgagggttgttaaggttgtcgttgtcgttgttgttttggtggtggtggtggtggtggaaaccagcgtagaagaaaggatcggtggtggggtgttgatagcaaaaaggtgagagagggaaattggttttggccttggaacctcggagagtccgagcggcggcgtcgtaggcacgtgcagcatcctcggcagaatcgaaggttcccaaccaaaccctggctttcttcaacgggtctctgatctccgccgcgaatctcccccacggtctcttcctcacgccccggtatcgaggctcctttaaaacggatccgttcacctcagccaccaccaacgccgccgccgaggctcctcctcctctgcccttccgcatctcttcggagaaataatgaaaccaaaaaaaaaaaaaaaaaaaaaagacagacaccgaggttcgtccgacacgacaaggtgtggtcttggattggattggagctcagagagacatgtgtgtatgtatgtgtgagtgtgatatatattaatgggtttttttcacaagtgggtgttatggagatggaagaggtataataagatgatggggatgagaaatggagagagaaaggattgaaggcggtaccaccttctcttcttcttcttctgctccttcaactacacacactcaaatatattcttaataaataatacaaaaaatgggtcttcagcgtgttcgcgtttttcttctctcaatggctttcctgcctctgtctgtctctaatctaatgccatttttttattataaaaaaataacttttttattttaatttctttatggaaaaatatttgtcaacatctcaaatgctagttaacacggaagagaacgaaaaaaataaaaaatataatatgatgagagaaaaataaaaaatattgataaattgttcaaaattaggaggtgttcaaaaatagactctttctttgttgcctttctggctgccttccttctctaactgacctcttgtcttgctttatttatcccttgctttatctgctgttatattattttataaaaagaatctctgttttttatgtatttttctcgtttacaaattacgaagagtgagttaagggattctcgaaatgacgagaaggcccttgggtttcttggaagtaaatttgccttgccttggttggtgtacttttgatttggtgaggtccctttcatgatagcatacctctgattatttcttcttcttttttctttttttttttttttttcttttttctgggtgcacacacagagggaggggtaaacataaatgcaacagatgaagatcttatctctgttttaaattttaataaataaatatactaatttcctttctatgaagcaatggatttcgatcgatttcctataaagaaattagtttatacagtattttcttttcatctatttcaattatttcggctgtggacgaggaagcgaattatgtgccatgcgtaattgcaattttttatagccgcttaaatgtttgtttttatttttgtttttcataagaactttattaattactaattagcagtgtgaactaactatattttatctgtacgtatttttaacactgtatatacacgatcttaatttttacgaattatgattctacattattattattattattattattattattattattattattatatgataaaggggaaaaaagtccaagcaaaaacaaacagtgagtttaaatagatattaatagcctccatcttagtttcaaaaacatgaacttcaattttaagacttctcaattaagcgatacaaatcttttagtttaggatattttaaaaattataaaaatgcttacgttaatccataattgtcaatgcggttaagtagctcacttactctttttttgtacaagaagtatctcacttacttaaaaatacatattccacataattaatacttaatgtcgtagtttcattttttgctaaaaatcagaagaataaacaatgtcaatttattgtcctcggccaaatacttatcttttttccttgtatctttcgatatgacttttatttattaataattagtggtgtgaattattcaacgaaaaaaagtggtgtgaactaactttcttttagaataatcaaagatgtaattactcaagtgaactatgcatttttcaataagcacacgcaaagtaaaaaatacacaaatgatctcatctgtatgtttatatgttaaaacctaataactaaatacattttccttccactaaatcactagattttgattttggagagattttaggccaattctaataatgatccataaattttattttctaaaaggaaattagtttatttttttctttttgttcattttaattatttaggctgagaggccataagttggatgtgctgtgcacaagtgccattcacatttagccaaatattaatcctttctgtttgtaattttttataggaactttgataattactaatttgtagttagaactaactttttattgatataagcgatggtgcaattacttatgtgaattgtacttattttcagacgcaaagtcggaaacacatggatgttcctatctgtaagttaaatcctaatgaataaataccatttccttcatctaaaagaaatagattttaattttcgagatattttactccaatttctaataattatccataaactttcttctttttatttgcaatttttattagaaaaattattaattactattttttttaaaatgattggtgttgtaacaacatatgtgaagtatatctattttcggtgggcacatgcaaaatggtaatacacaaattaatgatcttatatgtatcataataaataaatataatcttcttcctctaaagcaattgattttgattttgaagaaattttatgccaaattctattaataatctgtaaatattaaattagattttgggtttaattttaaaaatcaatttaattcgataaaaattaaggttatatgcatataaataatttcagttagaaaattgccatgtctttcttatatttctacaaatatgagttttaagttacaatttacatgatttatattttctacaatgttgttctttaaataatatcctattatttcgatatatttatgattttttccacgtattttcttgaaaaatcgattccctaattttcaagaatcaagtactttcttgccgttttacataacatgaaccaaacaaccccttaaaaccaaagaaaataaaagagctaggggggaggacacacaagatatacaaccactgcatcataattcatatgattgagggtaaatacgaatatagtatcataatgagcacattataaagaaaaagcgaattggtatattagtgattattacgatagtgaatatactttaatagtttttttttttaccaatactttaatatttggcaattgtttaaaaacattgacatcgcaaaagaaattttgatatcaacaatactactttaatatcaacatcatatctaatttaagttaattaaaatcgatattagataaatctaataataaataaaagaagattaaaaaaagtggaaaaaaagaagataaagaaaaaaataactaaaaaatatcatataaaatataaaaataataactgatataaagttacatcaaatttataattttttttcttttttattctaaaatacaggccactaatctatatcttgttaattgattggacatgatagtatagtttttaaataataaaatgaaaataaatagtcttgttagatgagacatgtgttgaatttgtatgtatggaaaattaaatcgtactcaaagtcgttttgaaaaataatgtgaattcattttatatgcatctatactcagaagaaaatatcactgaaattctcgacaaaataatgtttcaaatatcatcaactacattttctccccctgtcgaggcttacgtatgaaagaaaaggagttttttttttttttttttttttttctgggtaagaaattcaccagactggattttactgaacaattggtacgtttagcatttcttccccttcttcagctttctttttaaagtaaacagtaactaaagcatctaccatttcagatagacggtgcaattgtccaaggcacgataaaaaaagatacaactattcagaagcacagtaacatgcctgctagtttaaaatgctttaatttaatttcgaactatttttcatcacatgcatcagtacgtagggtaaaggaaatttaaatatattttttaaaaaatttaattagtaaaaagaaatataaataaataaagagacattaaaagacattaaaaaatggattacaataagatagtagtgaagaaaaaaataaattacgaagttataacctcaaacgctatatgaaatactactaaaacaatatagaccattcaaataaactcttttaccaaacatactaatttaacaaactgtttttttaataaaataaactagaaagttatttaatctcctcaaatattgagctagtttaaatttattttttctaaaataagtatgttttcaaataaaataaatagttttgtattttctgatgtgtttgtctaaaatatttttatttaaataaatattttttagaaatacaacatatttgtttcttaaaaaatacttataaaaaaaatatttaaaattactttttaaagtttaaacaaactatcatactattttactccttcttctacataatatatatatatatatataaattgatcaataaactattttagatttatattcctttgatattttcgattggacgacgactttcacagttttactaattattgaatttcgaccagtttcctaaaattactagtcaggtatccgttacacatcatccaacccttgacccttaagtaagacatagtctacgatacgaaaccaaaacatgtctcgtacagtgcgtgagtaattttggccattggatcgattttaattttcttcaaacgattattattttctatttttattatttatctttctttgattagcttccctttctaccatttttcttttctctctctcttctctctccgcattcccgtctccacgttccaaccccattctcgtcgccctatgtcaccatcgaccatgacgacaccaacacgtttgagctcttctacgacgacggcaatggcaccggctcacaatgatgcaagatatcgtgaagatgatgcaagatatccatagagattttcttctcttgctcacgatgggaggtgcacggtgcacctggatttttctgggagggcaaacgcggtggctaggagagggaggggaggcgacaaaggaagatgaagggatggaagtggaactgggtcggagagtgaagggaggaagaaggacaaattggtatatgactgaaaaaaaaagtaaagaaaaaagtaaaataaaataaaaaataacacgatccaacagatgtaattactctcgcacgatatgagacatgttttggtctcgtactgtagactccaacattaagttttctccaacattaagtaaacttaaccacttacacaagtcatttcacaaaatctcgatacacacaatagtaaaatcatgataaaatagaccctcttaaaattatcaagtcgataattacaacataatcctgtatgtatttctacatttgacatagaagattaaacttttcacactttaatactctttaactatatctcattacatttttacatttgacatagaagattaaactttcacactttaatacatttgaagaatatattgattgattaagatccatggtcaactagtgatatatcaaaataatctatgatttctctttctctctctaactgtttatcaaaatatattttacagtaataaaatgaaatacacgttacatcatatgttcagtaaatatatgatgttataataagagttgttctattctatacctttaaaaaaaaaacaaaatgaatatattttataaagttccatttcataccatcttattttaaacgtaatgtcatttaaatatattttagaaattgaaaatttcaaaataaatacacttgtgatccaacatttattactgaatgaatttcacgtggttctattcatagagtaaaattcaatagataattaaatatagtatcaacatatttcccgcactgtttttgaattttgttacatattactgcacaagatggaaaaggtgataagattaacgattgtaaattgcaagatgtgaggacagagagaagtagaaaaaggaaaaggaaaggaaaggaaaggggtaggaactaggaagcaaagacaaagagagttagatagataggttaaagagttgtggggactcctctggaaatttgggttgcaattggccaaggcaacgcatgttttttttttttttcctctcttaatttttattttcttgcgaaacgcgcacgccagttgcagcagctcgctcgggaaacgcattcattcatcgaatcatggccaagtcaagtccaatcctttgctctctttcacaggcttttgtcttttccatatggtttaattattcatttcatttttaaattatttttaatgatttaatttaatctttaattttgtaaaaaattgaaaattaaattaattaatttttaaaaatttaaagattaaattaaatatttaaaatttaaaattaattaaattatttaaaataatttagacactaaattaataataaactctttcttttatttgttgttttggttttggtggactcgtgcgcgcgcgggaaaatgatagacccgcgcattttgttggttacgcaacaacaacaacaacaacattttcatttcgtgcttatccagaatacaatacattggctttgggtgggtgtggtcggttacgcttttattattgtttctttcaacgcaccaacacctactaataataatatcatatgctcacaccaccccaacttcttcatccaatcatctctcaccttcgacttgcttatttaaatctaactaattagattaccctaaactttcaattagtttaataaagttccagaattagctttattaaatactactaacagatgcaaaaactcattattcacggaaacggaattaaaccttttttattttttattttttggaaggcaaagagtccaaacccaaactaaaaactacacacaaataacacgggggagtctggtctcccaaaatatcagaaactaaaagctgcctaatttgaacatggggatgcacagcacatgtcataatagactaaaccctgccctaatgaatgtgtctcccgtttttaaagtaaaaagtatttttttttttaattctggtaataaacattgacgttgttgacaagtttttatttagtttttttttttttataaaaaaaatatttaatctctcatttaaccccttttcgtttatattgtctgttaaatatttatgtgactctgaaaaataaaaataagagataagataaaaggtcataatattttttagaaactaaaacaaatatcaatacttgtccggaaaaatagtgaaagactaataaataggattatatgaaaaaatttaaaattcgaaaactaataatgattttttataaataaagatagaatataaaaatggcaatatgttataatttgaaagatgtaatttagcataaaataagtatctttatgttgtaccattcgtaagttccttagcaaaaaagaaaaatgaatggacactgggctacaaaatgtacctcttcggtcttctgcgtttgcgtgagtgcaatttttcattgattattcggtatgatttgggaaatacccacgttaaatagataatatgcgccttattaataaaaaaatatagaatgtctgttgatttaagagttcgattccccatatttgtgtgaatgtaaaaatattcattgaaaaaatgtagtatttcaaaagatggtttaaatatgcctttaatttctgctatatattgtttctttgtttgatcattgtagtattattattgatttttttggtagaaaataaaataatatttgttatttttaattagttcttttggaataaaatgataaggactaaaagcaaattaatcacatattacaataacaagcaccaaaataaagaagagaaatcttacattgattatttttaaaaaaaaattataaggacaaaaaaaacaatcaatgtattatagaaataaaaaatatatttaagtctccaaagaataattttaactctgaccggaaaatatacatagtctataaaaagttcatatactgctattacttgttttttttccttctttggtgtatacatatgatgaaattttattaagaataaaacttggattattttgtgtatggtagaaaatatatatgaagacactaaagttaaatatttatgttaattcgttgcattgaaaaagaagtttatagaattaatttttaataatcttaagtattttcaatcttttggtctaaattttatgttctaataaaattaactattcatgtttatttttttatattttttattttatctaaattttaaaatacacacttaatttataataatatatttcccaatttcttgaacacatttagttggcaaccatttattttaacagaaattataagatataatattactaaaaaaataaaatgttttttaatattatgtgaaactgggcctgggcccgttaacagttttggttgaatataacatggcgactaaagaaagtccagcatcacatgaaacgaacaaaaattggcacaaataagatttgggccgatttctctaaaatgttgacgggtagctccttcctaatcggctcattagaatgacaataaaactgcttgagataaaaatttgacaaaacaagaaggaaatacaatgtaatagacttgacataagcagaagaaagcaacaatatcaacaataacccttaaccaagtcactgttgtcctaaacaaatttaagatagaaacacaaagtcattgagtacgttttgcaacattaccaccctttggtctcaaggctattgtgtgtggaccctcttaaattataggtcgaacacttacccaacttcacatttaaaaaacaaataagcaaacctttttcgccctctaggcttgggactaaagagttgtgaaggcttatagattgagtacttactccgtcggtaattataatgggttgagttcatgaggaatagtgaccaaagtactattgttcccaaaaaaattaaccagaatgccacgcgaataatattaatacccaaagtaccacgcatcctaattcgcaatgcgtcccagcaaattccgtcagttgatgtggtgtcaatctagtggccacgtatttcgctacaggtgccagcgaaatacgtagtcaaactgtgaatgaacgtggtatagcgaaatactattactatatattatatttattaactatgatatataattaattttaatactattactatatattatatttattaaataaaatatttttattgaatttaataaatataatgctcacacacatatattttgaccgtacaaatttctaaatgaatctataattaaaattttatgataaatattctttaacaatgttaagttaaatagatgaaattctgaaaccaaaaaaagttaaatagattaaattatgtatttcaacataaggaaaaggcactataatattcctatatctcaagagttatattacgatattaaatttttataataacattgtcatttttaattaaatatgtctatcatgtatcctataacttaataatcctaaaataacactaaatatcttctaacctaatgttttaaatctcaaagactcaaacctaaatattatttaacaactaaaactatataaataatatattacaaaaataaaaatacataacactaaattacaaaaaataaaaaacagaaaaatactaaaaaaagaacttacctttcacgctggggagagtgagggaaagtagagagggttatatagtggggaggaggagaggtttatatagtgggccacataggtgtaattcgcttgggcacgaattcgtccatgtctatcacgtgttaccaatgacttttttttattgtttgtgtcacgtattttgctgggccaaatgaattatgtagtgctgttatgtgtcctacctgtttatgctcggccaataaattgacgttacattagctgacgaaattcgcttagatgtattctgaattagaatgcgtgacattacgagaattaatactttttgcgcgacattttgattaatattttgggaacagtggcactctgttcacagttcatgaccactagacaccaatagtggaacataaacaacttgagaaagggtaaaaaaatttgtcgattaacccttagtaaatacaatgtatttcgttgaatgattgacattacatctgactctctcaccagaattcctgcataacacgcctatggtttgcagtggccggaaaactaaataaattatttcactgaaataagtcaaattaaatattcactaatttattatagattatagtgtcctttgatagtttttcttttcgaaattgacatcaccactcatggtcgagtcagagtggctgatgaaagctttcgtcctttgatagtattttctccccccttttttttatagagaaatcgacggcatcacacgcatggtggccggtggccggtgggtatgcaccaagtggggtttttcttcttcttcgtctctctctctctctctctctctctctctctctttatatatatatatatatatatatatatttaatatcattataattaacatatgctctttcaaagccaacgtatcaatttgtttctatatagtcattattttttgtttatgctaacaatttagggagcttattagttattagcctccgttttacgtacggtgtagtctaataaaagtttgtagggtagcactcgtttaaataaataaaaactatgatagacattccaaagaagcttgcattgcttgctataataacttgcacatcaagaagttataattgctttaaaagagtagaagaaatggatccttcaaagaaacgtaaagtagaaacacaagttaaaaaaaaatgtaaactatatttttcttcattgaaaaaatagagataattacaaataaatgagtaaaagaaatcaataaccccccaaagtaatcatcataatgatttattacaaacagtaacgctaacgcaaatttctccatgcctaaacacgtgctaccaatggaaaagctcataaaaactccggcgaaatccagttaaatccaaatcaaggcttcaccaaaaacactccatctccgtcatttcagtgtcctgtgggaaattcgcaattaccatactctgcaacacaaattcaaaaacacggtttcaacacaaattaaacaaaaaaaaaaaaaaattaaaatctaaactcatgcataatgcttttaatgcaatgacatggacaaaataaccgttctatgtcgaccatatagggccgagcaatcaatattcaataataaaccctcaatttcaaccttatcaagtatcaactgatagggccatagggcgaaataaacaaataaaacataacatttcttgcccgtagttggtacttattattaatgcatgtttatttaatttattttgatcaggggaaaataggcattttgtgtctcacggcgttttcaagttttttttttttaaaaagatagataataaaagttaggagatagtttgtaaagaagattataaagtaaaataataacacacagatataattatagggataaaaatgagtataaaaataaaaatataactaagtgattatagcagcagtacttactgggaggctgagtgacgacataagcagtgccatcaaaataacacgtgccggatgcacgtgcctttttctgatagtaactgttgaaagcgtaggaagcatgtgcctccaaggtgttaggatcgtaacacgtggcaccaggctgaatgggagtgcaatcagccccaccctctccgcaagcgtaattaagagcgttctgcagcttgttctccgaagaaccgccattcgccacgcaccacgtctggcccttagacgacgtcgtcacgtcaccgttcaccggaacctggctctttccaaccccggacggcggcgcctccgccgtaagtggaatatcataaaccttgttctcacttggataaaacaacccgtagttcctctccgacgtgggacccgttttctggttctcattgaaaagcgcgaagaggaaaacgtcgagtgactcattgggcttcaagggggtcccactcccactcaacacgcgcttaaccaagtttccgttatacgacgccgcattgtccgggctggctccgatttcattagagtccccagcagaaggccaacccgtttccgaaacggcaatcttaacgtcgtcgtatttgagtgctgacaaggcagcaaaaacggcgtcgatttgagcgtcgaacaagttggtgtattttaaaccattacccgaatcaaccacgccagggttttccttcaacagcgcgtagtctaaagagattttatcagagtttgcagcgtaagcgaagaacggataggcattcaccattaggtaagaaccggtttggcggagcaagtcgagcatgggtttgataaccggttcgagaagttcggttttgaaggaaccggatgaggcggggaacgagttttggagcgcggagagtgcgatgggtgaggagattttaatgtttttgtcgaggttgtatttgactagagaagcgtgaacgttcttcatggcgggtacgaggaactttgtcgtgttgtttgggtccacgaacacttcgtttcccacggctatggcttcgatttgcgtggcggggtagtagctggagatgttggcttggacccacgcgtcggtgaaggactgttccgcggcggctttggcgagaagctcatttggcatggcaacaacaaccttcattcctgagttggcaaacgcggttaagacggtggcgtcggtgtcgtagagcttcacacggttcagcccctgagtcttcagaagctccaccactttcgccggtgtaggtaggtcgttcgcaattcttccatagtttattccgattgatcccgcttctgcaaagcccgtcagaaagttaacaactttcaaatgcaaaatgaaatgaagcaacaaaatatacatgcagtttcataagtgctattttctaattacaaccagagttcatcttggtaagacgaaattctaatacaaactgaaagaagagtagtgagagatgtatttacctgatgatgaagaaaagaatgagataaggatgaagaagaaggagaatgtgagaggagccatgctctgtttgagagagaagcagagcatgcagataattagagaggaattaagaaaaagaaagggtgcagttattttgtttgtgagaagagagggtgtggaattttatagagtgattggggacttagtgggccaacgtggttgaaggaaaagagctttcactttacaccgtgtgggacccttgacctgtgttggagacccaaccaccaatgcactatctcagagccgctaatgttaggttagaaaaaatgttactacttgcggaagacaaatgttttttttttttcctgtatagaaaaaaaaagagttagaaaatgttagctgaactgtccgttggatcatgtagtaggctatgttattgaccgtacacgtgcagcgtatcgtttgggacaacgttgtcgacagggacacgtctcgaatggaacggggtgaggtcgcgattgccaagggacatgtttggttctatagccgagaaaatataatattattggcttgattttcgattgaaacaatgatgaatttacggaaacagggccaaggtttcaatgattttgctcaaatttgaacgttggactttgccatccagccgtgcttgatttgatgacatgtgcattctctctgtttttgtttcttctgggtaaaaagaaataaattgggtgggaatcaattaattcaggactatatatataataattcatcaattctctcggcaaatgaataatactataataggcatcatcatcatgacagagtaatactattattttatgattttatcatttgctatgggattttactttacttcagggttacattcatttcttgctgtagatttagagatctccaaatcaaagtttgttgaatgatttttaaacgaagaaatcggtttttataaattttttattggagtaaatttatgtaatatgattttaaaaaaataagatctgtatttttataagaaatcatttcttaacaataaaaatactaatatttatctaatacatatcagggattattccaaaactactttgttagttgtaacttattttaaaatatgtaattgttatttaaaattaaaataaattgtcgtaatagtttatataattaaggataaaaatatctaaaaaaatgagattatttattttataatgcttatagataatgagtttaagtagttattataaaagttttaaagaaatcacaccgtgaatatgcattcaaattaaattaaattaatatttaattataatcaaggggaaaaacatgcatgtttagttttaggttagaaaattaactgtagttctaaaattgattttagataaattttcatatatttaattttttataaaaaaattgaaattaaatttaagttctaaattgattatgagttgaaataattttgaataatttttgttttagataaaaattataatatattttatttttaatttgattttatagtaaaagtattcaaatataaataaaatttaaaaaataatttccaaaataaatttgataaaatgatttgtattcaaaattagttttaatctgtcaccgtgtatccaaataggtacgtaattccttaattaaacaaatggtgtagatcagatcaaatgaagttaaatctaaaaccaatgaaaactacaagatttgtagaacatttgaagaggacaaactagagtctgtttgaatataagattaaaagtattttttgaaatttttctactgaaaaattactatattttaaaaaaaaattctcaaaagtaattatggtatgtatctaaatatgcccgtaatgatgaagacttgacaaaggagaaatgcagcaggatcgatcaataatcattctcctcgtttggcaacgggaaatgttggtaattgatctgtgtgtttccttctgatttcattcatcccaccacggaatggtatagccattaattaattcgaaatgatagggattttatcttagtcaaaatctcaaaaggccgtgaaagacactactacaccatcgtgtggaaattccatctttttccccacgagtttcatagaaattttacttgaggaggataataactaattccttgagctaagcaataaaaaggatttctatacattttcttattagttattattattaatgtgatttctatcttatatatttggtggatagttaaagaattaaaagtacagaaaaaaaatcataatgtcaacaacaaataaattattccataattttttttattgtttaacttgttaatctatgtactacatatatagccagtacagagatattagagtaagatttttcttatgtcgaatacattatcagagttttttagacaaatgacatgccaaaattcaatctatgtactacatatatagccagtacagagatattagagtaaaaaaaaattatatatataccattaattttgtttatttcatgtgttgtcaaattaattaaattgtataataaaatatattaaatgataggataaagttttttagacaaatgacatgccaaaattcaatttttgtcctttgattatgatatgtatttcaggattactaacatttaatttagtgaccctatgaaaaagaaaatgagtaaattttcaagtgaatgcacctttaaatagctagtgaccgataaattaaccctaaaataacgactttttttttgtgcagcctgaaataatgacttttgggtagggtgtaattggtatcggcttaatttggccccaataaataaatttacatattttagtattaaaataatatcatttgatggttaaattattgtactgatcatttaaaagtcagatgattatttttaaaaataagaatctttaaaaaactaaacagagattgatgctatcgtcattgatcaaatcctcatccaaacgtatcctaaaatagcaacatatacaaccaaaaactcaagttgctccgttatttttacttagtttgtcctaaatgtcatattttcaaagggttttcatttaacattattttagtctacataatcaaaactgccaaatgattgtcacaccctatatccctataaacaaaaagaacaacactaggaaataataattaatgttaaaatattttatatttatccatttttatcatcttaattaattataactaaatttatttcatttgtcatactaccgtatggacaaggtttgagaaacaaatgagaaaagataaaatgacgtgccattagcaagaagaagaaaaaaaaacagaagaagaatgacgtgcgattaatactttttatacagaaaaaattattgtgccgtagattagtcggtgaaatgccccatttttccatgctaacacaaacagccaactagctttgcaattatgaatgatgcaatcaaatacgtatgggggaccttttgctaattgaaaatgcttgcggacgaaggtagtagtaattaatactttggtgccaattaataaaacatcaattttagtacttgttttctgcagccattttatccttcaataatattattaaccataaagaaaattaacaataatggcagccattgaatttatttatcgttgaattaaccaaaggaagtggtcggagttggagggcattttctttctttcttttggttcaactctcaacgccacacatagggcgttggcatgcacaaaaatgaagatcaatttgaaggtcccatttcaggtcgtcacagtcatgtcattattcaaattaagtaaaagggacttgttacagaaaaaaattgttagatgaaagatatatttttatttggcacatgtattgaattaatttaattaatgatcagcttataaattttaaaagatatatattatcgaatggtagttatcaacaaatcattagctgtatattttgcacactaaatgaaccttttattttaatcaagtcaaaattggtttgtcaacttgcatctttccaatttcacacaggtatcgtttactttaaaaatcttaataataaatagggagctaagacgtttctacacttaaactctcaggtgtactaaaatatgataggcgatttggattcgtaccctcattaggtcggtaagactcattcatatatatttcataattcatagttcatagtgttcaatttcttaataactagtgttacattagatataattgcatctggtacacttggttgtccaagctaccagtctaccacgatatgtgatggagaataacattaacaagaagtaatacaaataaaataattagtagtttatgtttgtcatcttaagtttttttttttccttctaaaaattcattttcaacaaaagtagaaataaagaataaattaatagatcattcatgctaagcttagacgatctgtaaattcttcaattaaaactggagattttaggtgaattcatccctaaaactatacataagcttatatgggcaatttttaatgtctttatgatggaggttcactctacggttttctggttggttcacttggacaccaattttagcttgctagggtttgattggggcactgtggtggggatgaagatttttttttttttttttggagggagaggcttttgtccaaccatttgaggagggagcattttattgttcgataaggacaaggagatctcaattgatggattgggtggaagtgggacatgcatatatcataatgtagacgttatgtttcatatttatccttgtttctagccaccccaacagaaaaaattggatttatcttttccatggcttcaggcataaaactgtatttgtaaacctaagtaactcgttcaccaagaacataaacgatagaactcatctttagctgtgaaatatttggttagaaaaaacagatatataacttttcaaactaaaaccaaaagttagtttagaaagaattaacttcagggaacaaattatggcaatatattgaactagaggattaaacataaacctatcaatatatttaaaacaatctcatactctgctataaaatcttaatctttattattttcattctttgatccccctccctacctcctcccccctccccccccccccccccccccggcaaaaaaaaaataaaaatcccgaaccttttacttatcttcccttaaaataatatatacagtgtaaattttgggtcatccaaattcctggcattgaattcaatcttcattgtgctggagtgagaaatagatgtaaatcttaatgggaaagcattcaaacgcataggattttgtatttatgattttttatacccgaattagaccaagaagccataatcatgtaaatcataatgtggaagccgtgaaacagagaatcgtgaaagtcatgattgtccatatcctgattaaataaaatcataagcgtcaagaacgtctttgagtataattgatgaattggtttttcttccatctcactctttttgacacacatagtacggaagatttttaagagcacaagtggaaaaacttaacgtgtgttttaagggagagaaccaataatacgttcctcaagtattagaaccaatggatgaagtcaatttaatctttaaaaaaaattcgatacaatttaatttaaattttaaatagtgaacaaatacctcaatcttatcagtttaggtcactgaaggaaacttacaaagccataactttccaataaaggattgtgttacttgtgaaaggccagacttatttcaagtttctcttttaattcctgtatctttcgggtgcagctcttttcattttttttggtccacggatgattttttgtttttggtcattatcagtgtctctcttagttcatgttatgaaatcgatttcattagggctattacatcttgcagtcccactattatatcatatacctcgtgttgcattctgaaaaagaatgtaaatgaccattttgaaatagtcttttcagaacataatagaaggtacaagatataatagtgaaagttagagtataagaaataaatgccgataatgacccaataaataaaactgttattcgggtaggcctctagaattatgattgggagttgatattcagaccctttttctgctcttcgcaccagctcctttttttgtattttttattattactaggagaaaacaggcaaactgtttttccattttctttgaataaaaagaaagataataaaagttagtgagtgatttgtgaatatgattatagagataaaacaataatttattattgtagttattaaaatgggtatacaaatttatatactaaagtaccctatttcctttatatatagttatagattatagatatattaaggaatattattcttgtttaaaagatattatttgtttcttatgtaagaacaaagtattttaccctttaaatattgcgttgtgatctcaggtttgccaatcttgtcccacttacccctttgcacttattagtgtttctaagattcttaagcagatgattagatcaatgtttttaaatgttgttcatccagggtgccctatgataatttcgtccagaactgccctttcaaacgtcaactccaatttacagaataagggcaaataaattttcgaatgttactccttggtttctcacggttcagtacaggtgaaagaaagttttccacatcagtcaaaaggatactcacattagcttatttatcataagcaaaagcgttaaaattgaataatttcagtttcaccacatacacaacacacgtacaacagaggcagtttcaaacccaataaagagcaatgcacttgctggctctttgtcaaaaggagtgcataagagaatgcacaggtgacatgtatagcattcagagtttgcttcctgcaccctcttgcattaccaagcaaaaatatgaaggtgcaagaagtttcactcttagatccaaatggaaagtggatagcgggcttagctttggacttatggtccatcaggaagacgggcatgtcccaataacacgattattaatgtaagttggtcttccataaaaaggctcctactatttacacccacgttttctaacaaataggataaaaataagactaacaaatatgagtataatataaatatttatcatttatttatttatttattgtaaatcagcttaattcttaagtgatattttattaaaaaatatatacttattctggaagtatatctttataactatgaatcattgttagggaaatacatttacggaatgtgtatatgtaattttggaaagacatttttggaaaataaaaggggtatacttctttttataatgagtaattgagaggtaggaagggggtgtctggggtgtaaatagcaagagcctaaaaaaattgtgagttgagtttagcatcctaacgtataatgtagaagattcacaaatatattttatccaaataatttgtcctattcacatttgacgaattgaagttattattatttttatctcataaagacattaaatggttgaatagcttttgaagcagcacggatccaaaaaaaaatcagctgtagaaataatattcacatatataattaactaggaacgattttcatattatagttttttttcactacatttcaaattatgaaagcattttgtaactatacatacattgagaaaaaaatctggtggtgcagttgggcctaaattgaatccgtccctgtttttaggttataatatattacataccattcaatcaagttgagtataattattgcctagacttagcaagcttacccaaaactatattaaaatggttgaatagcaagtgagtataaaataggcattagggtaaaatttaacgatatatcattagcacaatatcatgtatattaaaaaggattactgtgggaaaaaaaatcctattttgaatgactaggcaataatgtaaatatttatgattcaaaaataaattttaaagaaataagaaatattcacatctaaattacttttttctttctttctgaattcacacctaaaatacttaaacacgacaatagtactattttcccttcttttcttttcttttcatttccggctaattaaactagtttttttttttaatagagagattcctctagttacatatgagattatatatacaatgtattttctctatttcaaattgattaacgtttacattttttcccacataatttaggaaaatacgtaaccatttgtgtaaggcaacatattaacaaaatttgttaaatatttaattgaagatcgataaaaagaggcttttcctatttacccccgactaaaagtaaccaccctaaacaacaccagacttagtagctaaaactatcacttgcacttaaccccaaattacctaaataagagtaatatccaaacttaactaataggataccctattacatctggtcacgtgatcttacacgtggaatccaacaaacccaactgtctttctcgctgaatatgcctatataggtgagtttttcttaggcatgaataacttcactcattcattactctcatagacattttgatttgatcgtgagaatctctatgagtaacactaccaaagtcactcatcaccatcatgaattattgtgccattgccctgattcatatccacatcacaacaataataaaattgcacaattataatattagagaatacgatttatattgaaaccttaaaagatcaaaatgcaccattataatacctaagataggaaaagtctaattaagctaaacataaatagaaagtttaaccaaagggaaaaagaattaatcaaccggaccgagggtttggaaaagtgaaatttggtattgtttttgtaatgaggcattcacatgaataaagttaccttccatgaatttgcttacatacacaggtagttcagttctttcgttattgtaatgtgaggcattcgcatgaataaagttaccaaccatatttttgctcacatacacaaaggcattaaaaaacaagacacatccagagatttttacatacacaaagacattaaaagacaatacacatggcacataccgttatgctagcatccaagtgagaattgattgaattcctgaaaaataccttttcaaacatctcgggctccattctatacattagcaaggctaagaataataagtttccttaccgttccaaattgaaatgtataataaagccgttcaattacacagaaaattcacccctatcatgtttctcacgcgcccagcttgattaaaaaatatattttctttacattctattctattaagctgtttgaatttgtttacaaacaaaacaaacgagagaccaaatgcactagccaagaccctacgaaaacgacaccgtaaatcgtaaccccataacactagacacagcatatataaagagaaacaaagatatagcatatgggggaagagagagagagagagagagagagagagagagagagagagagaaatgaagaaaggcaatgttcaaaagaacaatatacggtgttcgacactatacattgctttactctctctcatcacaatcttcattattcccttttgtgagtccttcaactatggccaagccctgtcccagagcctcctctatttcgagtcacagcgttcaggtcgcttaccctacaatcaaagggtcacttggcgtcaccattctgccctcactgatggcctagaacaaggggtacatacattacttcatattaatatattaaccttaaactatgttattttccttttgtgctagcttttcattcattctaatattatggttattgtttttttgggcacgtaggtggacttggtgggagggtactatgatgcaggggacaatgtgaaatttgggttgccaatggctttcaccataacactcctctcatggggtgctatagaatacggcgaacaaatcgctgctgccggcgagtatgctcacgctctggagactatcaagtggggaaccgattatttcatcaaggcacacacacaaccaaatgttctttgggttcaggtattaatttcaattccagtgaatttttttttttttttttgaaaattgattacccacgcgccgccgttgaaaatgggatgaatgattacttcttccaagctaaccggaggaatagatttaaatgtcggagctgtcaacggattcgtccgcaatctcgccgtgactggcgcgcgttatcactcgcagcttggcatgaacacagaattttgtaaatgagatttgttaaattagagtatctaaaaggaaaattattatgtaaaatccggtcgtctaatttcaattaatcatgggatatgttatgaatttttttaataaattaagaaatgtaactatttatacttattacataaagattattcgacacccaacgtccaattaaaaaacataaagatttgtcggagattataatatcttaaatcatatagtaacaattatttttaatatattaattagaaattgtgttactatataaatgcaaataatgagtaatgatatacatatacttatttattttaaatattttatccaacatttcttaattctttctttatatcaatcaaattataaattctttcatacttataattttttctttttttcaactctacctatctctaggtgtaagataacatgtttatcaaacattgtccgcaaataatatatttttaatactgtacgttatagatttcactagtttaggattcagacttgcaaaaatgacaacaacatatttagcgaaagatacagaaatttcactcaataaaaaagtaaaaaagaagtgtgctacggtaatgaaatgatgaagatgttaaattcctttataaaagtggttatatgtgtatatttggtcttatgagttaaaatgttcaggcgggtgacggcgacactgatcactactgttggcagcggccggaggacatgacgacatcacggcgagcttataaggttgacgccaacaaccctggctcggatgttgccggcgagacggcggcagcattggcagcggcatccattttgtttaggagaacaaacccacattactctcaactacttttgcatcatgcacaacaggtatatgagttagttttattgacaatgttacgtagttatggattaatttaattaggattaatttcaatgggttgttgtgttattgtagttgtttgagtttggtgacaagtacaagggccagtatgatgagagtgttggagtggctaaagggtattatgcttcggttagtggctacatggatgagttgctgtgggcagcagtttggctatatagggccacccaaaaggaggaatatttaacctattttttggagaaggcttatgactttggtgggaccacttgggccatgactgaattcagctgggacgttaagtacgctggtgttcaagccattgcttccatggtaattccctcacacttcccaattcaaagagtcacttcccttctttattgtaaattgtcaaaaaaggtgcattagaagtactatactcactttgaaaagaaaaaaaaaaaaactaaaaagcactatactgccagtattattggaccttagttacatattatggatcatcattgatttctttatacatatagagagaggagtgacactctttctcacacttttttttttatatatttgttttataattagttaaaatttatcaatttttacaagttttatttctcatctaatataaattaggagagaaaaatatcaattaaaaataaatactattaaaattaattatttcaaaaattttaatcaataaatattaaaaaaagaatattaaaaaatgtcattagcatttctctctctctctctctatatatattttcttcagggtctagcattagcatagttggattcaatttacacgagaataaatttttaaaatatctttagtgatagatttcaaattgaaatattatatcactttttgtagttttcttaaaatcacataattttttttttagtattagatctcattttgagatcttaagaaaagagaaataaaaaatttcttcacatattgagggttcttctataagaactcattctttatgttaaatatctcttcaactcctttatcagaatatctagtgaatatcagatattaagttcaaaatctttattcaagatctatcactaaaaataaattttaataaattataaaaaaatgtttaaaagagtacaagaaagaatgtccctgtcattcatgtaccgtaaattgcttaccgacatttttccttttaacagttccttatggaagaaaagaagcacaagaaacacgaagtcatactcaaacagtatcgttcaaaagccgagcactacctatgcgcgtgtctgaacctcaacagcgttaataacgtggagcgcaccccaggagggttactatacatccgccaatggaacaacatgcaatacgtagcaacggcgtcgtttcttctcacggtttattctgatcaactcctagccactgatcagaagctgcattgccaaaaaggggaggtgggtccccatgagatgttggccttggcaaaatcacaggttgattatattttgggctctaatccaatggctatgagttacttggtaggctacggtccaaaattcccgcggagggtgcaccataggggcgcatccattgaatcatatggggaaaataagggttttattgggtgcactcagggttatgataattggtatggacgtgttgaacccaatccaaatgtactcattggggcactcgttggtgggcctgatatcaaagaccaatttaaagatgagagacgaaattacgttcaaacagaggcttgtacctacaatactgcagcactagtaggggtttttgctagattgcatcaatcacatgcacatgctgatgtttattacaatgaaacccctttggtagcttctagctaattggggttatagagaatttttttggtccattattccgggcaaagaatatttcttaacagtgcttacttaatttttgcactgccattgtaattgtagtttgagtatattagtatatagtaagatacaaactatacaatcaatgttgacgcagaaacgcgtctagagacattaggtggaatagcaatttgcaccacttatagttagcctagcaattggaaagagttgcattcgtagttaaattagaaggttctgttcttttgggttagtagttaaagacttggacaatttataccatgtgcttttattttttgtcatattttacgactttatttaaacctaagaattttaatttatcacaaagaaaacaaacaaactaaataattaaaaaacgtgaaaatttagtgagtttcaacgtcaaaaaggacaattgagagaaaagttttaagtttgatagattggcaacctaatagtaatagttgcagctaccgacacaaaaaggcaagtgtcatttgtaatacttggagcatgtaggaagggagatcgaatataacactaaattgacaatactatatgttttaaaaaattcacgagattcttgggtgtttccatttctttcttcataactctgtttgcttgtcttctgattttccattcttcccctttaattacggttgcaacgaacggcatgagctaaaggaccaaaagcacttttccttgtaaccgaatttgcggggaaatggtctcgcatgaggaaaagccacccaaaacgaaaatcaagcaggaattagtgccacgacgttaattcaaatgcaagtatatttattggtcacaatcacaaggttcaaaatgtggaaacccagcagcacaagagaccatgttcccatttattagtactacttcattttctcattcccgattggtcgacgcgctctgttagcgcgtggaagtgtcaacacggttggtacttttcactttaggacatttttaaggaagcgtgtgtttgtgtgaaagtgtcattttccgtgaagcacaattaatactagatttacatcaagaatgtttgaatgtcgtaaaaggaatactagtagtgcagtagcgaaaatgccaccctgcagcaacgacactatctataattgggataatttaatgaacagcagtaattaattctgcaagaaaatcaggaaaccataatggcaattcgtgatcactcagggcactcacgatttaagacagggacttttaaagattccggaaatttcatcaaaaccacgttaactcaagtagcatatgttaagacaaaagaaaagtagcatatgtgaaatataaatcagaaaaattccagcaggaggaaatttatcaaatgttgaaaaaaattgcttggactatactctttgaaactcgttatttaataattttttttttggagtcaagttgaaatcaatataggattttacctattaataataataaaaaaggcataggtagcacttctcgatataaatgcaacaaattaacactactagaaaactaaaagcttgaacgataaaagaggcggggggggggggggggggcgacaaaaaaataatcaatggaatacttggtaattgaaaattttaagatggtgaactttggccatttagttccatctactaatttttgcaagtcgtgcatatttatttatttttctcgaagaaaaccttagaaatcaatatatttttataaggaaatttctatttaagttttttgtttgggggagaagttaaaataaaggcaagaaactcaaccaaacacatgtcttggcccaagcctagtgagtacacgagatgcacaccatggcatcgagttcatttgttttgggcattatgccatggcccaaagcaaaacctgctgtgacctgaatcttcaatatatagtactcgaatctccttattttaggatcttaacaatgcattgattctaccgattttaccatcgtacgacagggcccctgatccacgaaacaaaatgctcattctttagttctatgtcactgaataataacccaatctatattggatttttcattaatacacagcttgttgggtaatcacggaccctcaaatatcaaatgcggaagcggaataaaatcaaatgaggagcgagagagacaatcaaatagttttacgtgggagaaaaccttcttcaacacgaagaggaaaacccacgggaccaattccagatcaaatattcactataacaataatgggttacaatgaatcaaatacaccaatgtggtggtacactcaatctctcaaacaatggtgatcactcaaactccctaaagtgtttcactcaaactctctctagagatctctcaaatatgcacagcacaaggcttgctcaaatactgcggaatctctcacgcagtcaaatatcaaatggcggagtatctcaacgccctctcaaatatgcaaacatgaaggcttgctcaaatgtgctctcaagactgtcacttgaggctctcaattttctgtgtgttttgccttcacccttgctcatctatttatagggtgaaatggactgggctttaagccatcaaatcaaataagattatatcttatcaattaaaagatatctattatatcttatcaaataaatattttctcaaataaatatcttatcaaataaagataagattatcaatcaactaaaaacgaaaattatccaacaaatctcacccttccgtttttcagtgagaccagggttcttcaacttcaacatcaacatcccggccttctttctcggcttcaatgtgccgaattcattagcccggctccttcacagcaatcttcaaatttccatgctggtaccggcttggtcatcatatcggaccaattcaaatcggtgtgcactttgccaagtattctgcaacgtactcagcctcggtcgtccatagtgccacacacttctgcaatcttgattgccaagagactgttcctccaacaaatctcatcaaatatcctatcgtcgattttctcgagtcggaatctccccctaagtcggcatccgagtagccttgcatctcggccaactcataagtctggttttcatgcagggaattcgtcacgtcctgcatttccttcttggggtatctcggttgttcttcttcaaccgttgtagaactcggttcatcaccccggttctcttcatcaactcggacctcaatatcttggtcctcatcagcttcttgctggagatcatcatcttcagtttctccccctgcttcagtctgcacaagagggacgggttcttcacctcggtcacgagggcagccgggttcttcacgtctgacagtaacccgatcttggagcttcgagatatcatgaagagtctcatcttcatgaaagatcacatctcgacttctcactatcttcttcttgataggatcccacagtctgaacccaaactcggttttcggcgaaccaaggtagatgcattccttcgtcttctcatcgagctttgccctttcatctttagggatattcactaaagctcggcatccaaacacctttaggtgatcataggtcgttttctgtaacgtcccgtatgcatccggttcattaacattgatttatggtcattaagcgcagcaattatcacagataattaaatttggaagcgataaacttaaatgacatcatcaagcgtcatgaacaaccactgtacatcatatatggtgaattcttataatatacaacgtatatttcaaaactatacaaaatccctatcaggatacaaaataacaggcatgtatcaaaagatagagccaacatgctcttaaacactatgcctaaggttctcacagaacctatccctgctcgggcctcttgccctgggatctctcagcagctccctgagaatcacctgcaaaacataacccccaacaggggtgagataacaatctcagtaaactcagggtccttggaggtctttcctccccctggttcagttccatggcatataatatcaaaattggcattttaaactagtaatcacagctatcaagcaatattaccacacatacatagcatatttacaattatgtatcaaggcctgaggaggcattatccactatgtgggcacatctcacttggaggctcatccactatgtgggcacatctcacctggaggctcatccacgatgtggacacatctcacaacaggactttcatatatatattctatcaaatataattctactggccagagaatctcatcaatcacatatacaacactatcacagtgttcaactcatcatatgcatatgttcataaaacaataatcacacaatttcaatatacatgcatcatgatatacaataaccatcactccctcggagtatggtggaacacaacagtgggaaacactcccaagaacaaagagcttacctgctctcagcgctataccggctcttccggtttcgtggtcacaaccaccagcaagattactatcacgccctacacaagacataaaacaatcaatcaataacggtccttagccgttagaatgaaaggaaatgccattcccttccattaaaacctctctgttctctatcttaggattatcagagctaaccaccttataggtgattcacagaccctcaacaggatctatcttggtccaaccaagatcttagagtccccttagactctgcataagctcaattcaatgatctactaggtcatatatcaacaatttttcaacttggctaaaacagctatatcaacacattttcaccgtttatttatccttctgaacaacttttgtaaaggcacttaggctcataactatcataatatcttccttttactcaacatttttcctacccatacctatctcagggtcaaaaccaaacttcatcaaaaatcatgtttcaaagtttaatattcatcagaacaacctcctgagcatacttttctaaagaactcaagcctaattctagccctatcacaaaagggtcactattcaccccaagaacaaattctcaaatcaatcggtaaaacttgtgtttcttacctctaaatcgacagaaaaggctagagaacagcttttccaagcttgaacgtccttgaaccgccttcttttctcctcagaatcaaactttgtgaatttccctagagaactggatctctttgtttgatggttttcagagaaaagtgatgatggaatctagctcattgagtagttcctttcaactttcatgttgggtgtgaaaggttttggtcaacggttgagtgtttaagaagcttctctagttcatcaatggcagaagcagagaaaaggaagaaaggaaagagagagaagggctaagggaaagagagagaaagagagaggctgttatattcaccccacctttttaagaattttgtccgcaaaattcaaaaacatacctgtcaaacaactcggggtatagctgtaccagctcctgctctcgctcccaagtcgcctcctcaggtgtcctcccttcccattgtaccttaactatgggaatggtcttactccgaatctgcttctccatcctatccagaatccgtataggctgtgtaggacaagttagattctctcgaatctggacggtgtcaggctccaccacgtgcgacggatctggcacatacctcctcagctgtgacacgtggaaaacgtcatgtagccctgacaactggggaggcaaagctagcctgtaggccactgatcctactctctgaagaatctggtaaggaccgatgaacctaggactaagcttcctcacacccaaagcgcgtccaacaccagtaactggagacaacctcagaaacacatggtcgccctcatcaaactgcagcggcctgtgtttatgatcataataacttttctgtctactctgagccttcaacaacttatctctgattaaacggatctgctcagtagtctcctgaaccatctcaggtccaagaagctgtctctcacccacctcagtccaacatacaggagtcctgcacctccggccatacaatgcctcataaggtgccatacctaaactagcatgaaaactattattatacgagaactccaccataggtaggtatcgatcccatctagtaccttgctccaaggcacaagctctcaacatatcctccaaagtctggatggtgctctctgtctgaccatctgtctgaggatggtaagctgtactaagcctcagctgagtcccgaaagccttctgaagcgtactccaaaatctagaagtgaacttcggatctctgtcactgataatactctctgggacaccatgcagtctgacaatctctctgacatatagctgagccaacctctctgcagtatagtcagtccgaacaggtaagaaatgagcagacttggtcagcctatcaacaattacccagatggagtcacatccactctgagttctcggtagtccaactacaaaatccatggaaatgctatcccatttccactctggaatctgcaacggctgcagtaggcctgacggtctctgatgctcaatcttcactttctgacataccatacatgtagacacatactcagctatgtctctcttcatccatggccaccaaaatctccacctcagatcctgatacatcttggtggcacctggatgaatgctaaactggcccttatgagcctcagacagaactgcatccaccaactcgcccttaggcacaacgatccgatcttggtacaacaccaagtcatgagtctcccaggaaacatcctgttgaccaatcatggccctcacatcatcatcctgtttctgggcttcccggatcctctgaattaactcgttatcaatcttggtctctctcaactcaagaccactagcaccctctgttacagtcaggtgcatatctctaaactgctcaatcaacttacagtctgagattatcatgcaggcaacactcacatgcttcctgcttaaggcatcagcaactacattcgccttgcctggatgatatttcaactcaaattcataatctttaaggaactccatccaccgtctttgcctcatattcaactccttctgatcaaacagatacttgaggctcttgtggtcactgaataccactaacttggcaccatacaagtaatgcctccaaacctttagagcaaagacaatagctgcaagctctaaatcatgtgtgggataattctcctcatgtggcttcagctgtctggatgcataggcaactaccctcttctcctgcatcaacacacatccaagtccccgcttggaagcatcacaataaacctcaaaacaatcctcaggatcagggagagtcaatactggagctgtggtcaacttttccttcagtctcaggaaacactcctcacattcatgagtccaaacaaatgggctacctttcctggtaaggcgggtcaaaggtaacaccatctgtgagaacccctgaatgaacctccgatagtaacctgctagaccaagaaaactacggacctctgaaacattcttgggcctttcccaagacatcacagcttctatcttactgggatcaactgctaccccagctgcagaaatcacatggcccaagaatttcacctctgaaagccaaaactcacacttagacaacttagcatacagctgattatttctcaatgtctgcagaacaatcctgaggtgatcggcatgctccgcctccgttctggagtaaatcagtatatcatcaataaacaccaccacaaactgatctatgaatggtctgaataccctgttcatatagtccatgaacactgcaggggcattcgtcaaaccaaaggaaatgacctgatactcataatgaccatatctcgatctgaaggcagtcttcggtatatcctcgggcttaatccgaatctggtgatatccggatcgcagatctatcttggagaacacacttgcacccctcaactgatcaagcatatcatcaattcgaggtaaaggatacttattctttatagtaaccttattcagttgcctgtaatctacacataaccgcatacttccatccttcttctttacaaaaagaaccggtgctccccacggtgacacactcggtctaataaaccccttggacaacaagtcctcaatctgtatcttcaactcctttaactctaaaggagacatgcggtaaggagctatggatatgggtcccacacctggaaccaagtcaatggagaattcaatccccctatccggcggaagctgtgtaatctcatctgggaaaacatcaacaaactcactcaccatcggaatctctgacatatccaacccttgtctctcatctgctgtactcagcaaaagatagccctgagctcccctctccatctccttgcgagcttgcaagaccgagagaaaagaaatggcactcgagctgacttcatctgaaggcactacaaccttcttataacaacaatctagcatgatgccatacttggccaaccaatccatacccaaaataatctcaagggtaggcatcgtaaggcaatacagatcaacaacatattccttgccctcaaactgaaaatgcacatctctgcagtacatatctactctacattgctccttagaggcggtgataacctccataggagaagaaagtctgaacataggcaagttcagtcctagagcagtgcgatcactaataaaagagtgagtatctccagagtcaaataagactctcacatcatacacatcaatcaaaatagtacctctgatcaaatcaggaggtctggctgcctctctagcatccactgtgtagactcgtcctgcagtaggtgctactgatatcactggagcagctatagcccgaccgcctgcctgtggacactccctagcataatggccatgcttgccacatttgtaacataccaactgaccagtggaacacactccccaatgatttttcccacaagtagcacacttgggacgtggacctggtctcggtgaccctcctctctggctggagctcttcttgaatctatctgctggagaagaaacccccaaatctctgctcttgcccttcccagtagggcctgatccactgggtctcctcatctcctgtctctcagaggaaataggctggctgccactgcgtctcctaatcatatcctctacctggcggcactgtctcaccaggctgcccaagtctcgagatccactgccagctatcttctcctcaatactctctctaagtcctctctggaacttagcagcaagaacctctgcatcaggtagagccctcctgaaatgtgcatatttagccaactcattaaatttggctaagtactcatccactgacattttcccctgaacaagaccctcaaactcggcctgcttctgctctctggcatctctggggaagtatctgtccagaaattgagcttcaaaaacctgccaggtaataacttcaccctgacctctcaataactctgaagtggtaacccaccactcatgcgcatctccctgaagcatgtatgtagcatagagaagtctttgatgatctgaacattccatcacagtgaagatcttctctaaggcctgcaaccatctgacagcagcaataggatcatattccccatgaaaagctggagggtcatgcttacgaaaagcaatgagcatcttccctctagcagctgtatcctcctcaacatcagcttgggacaaccagtcccctctgtggtgactaggcccatcagaatgatgactacctccaccctgctggcgactaccctcgccctctggagtatgctgtgcagaagatactctatcctctctacgcagagatctcaactctgccatcaactcctcattggcctttgccaaggcctcattcgcctgtctactcgcagccatctcatgctgcatagctgccaaggcggctataactgggtcgggttgtccatctgcacccgtcgtctcactattgttccgggtcctcaccatggcactgcacatgtcacataaaagggtgagttgatcaggctcacactcaataaccacacatgcaatagtcataatgaacacctagaccattagtgaacaacacacaattcaccatacataatgcttccctataaaattgctctgataccataaaatgtaacgccccgtatgcatccggttcattaacattgatttatggtcattaagcgcagcaattatcacagataattaaatttggaagcgataaacttaaatgacatcatcaagcgtcattaacaaccactgtacatcatatatggtgaattcttataatatacaacgtatatttcaaaactatacaaaatccctatcaggatacaaaataacaggcatgtatcaaaagatagagccaacatgctcttaaacactatgcctaaggttctcgcagaacctatccctgctcgggcctcttgccctgggatctctcagcagctccctgagaatcacctgcaaaacataacccccaacaggggtgagataacaatctcagtaaactcagggtccttggaggtctttcctccccctggttcagttccatggcatataatatcaaaattggcattttaaactagtaatcacagctatcaagcaatattaccacacatacatagcatatttacaattatgtatcaaggcctgaggaggcattatccactatgtgggcacatctcacttggaggctcatccactatgtgggcacatctcacctggaggctcatccacgatgtggacacatctcacaacaggactttcatatatatattctatcaaatataattctactggccagagaatctcatcaatcacatatacaacactatcacagtgttcaactcatcatatgcatatgttcataaaacaataatcacacaatttcaatatacatgcatcatgatatacaataaccatcactccctcggagtatggtggaacacaacagtgggaaacactctcaagaacaaagagcttacctgctctcagcgctataccggctctcccgacttcgtggtcacaaccaccagcaagattactatcacgccctacacaagacataaaacaatcaatcaataacggtccttagccgttagaatgaaaggaaatgccattcccttccattaaaacctctctgttctctatcttaggattatcagagctaaccaccttataggtgattcacagaccctcaacaggatctatcttggtccaaccaagatcttagagtccccttagactctgcataagctcaattcaatgatctactaggtcatatatcaacaatttttcaacttggctaaaacagctatatcaacacattttcaccgtttatttattcttctgaacaacttttgtaaaggcacttaggctcataactatcataatgtcttccttttactcaacatttttcctacccatacctatctcagggtcaaaaccaaacttcatcaaaaatcatgtttcaaagtttaatattcatcagaacaacctcctgagcatacttttctaaagaactcaagcctaattctagccctatcacaaaagggtcactattcaccccaagaacaaattctcaaatcaatcggtaaaacttgtgtttcttacctctaaatcgacagaaaaggctagagaacagcttttccaagcttgaacgtccttgaaccgccttcttttctcctcagaatcaaactttgtgaatttccctatagaactggatctctttgtttgatggttttcagagaaaagtgatgatggaatctagctcattgagtagttcttttcaactttcatgttgggtgtgaaaggttttggtcaacggttgagtgtttaagaagcttctctagttcatcaatggcagaagcagagaaaaggaagaaaggaaagagagagaagggctaagggaaagagagagaaagagagaggctgttatattttccgacctgtccagacttcttcaggaatgtcttcttcaagtggtcttgatggtgacaaattaatcaagtcaactgctgttctgacggcttctccccaatatgctttcgacaatcgagcattggatagcatacttcggaccttttcttcaatagttcggttcatcatctcggcaagtccattcaactgcggagtctttggaggcgtattctcaaatcggatcccggcttgtttacaataagcatcaaagggaccgcaatactcaccaccattatcagatcgaaccactttcaacttcttgccagtctccctttccaccatcgcgtggaattctttgaaacattggagtacctggtctttggtcttcatcaaataaacccacactttgcgggaatgatcatcaacgaaagaaacaaaatacagagctccaccgagtgatctctcagtcatggagcatacatctgtatggacgaggtcaagaatcctcttgcgtagtctgggctgatccagtctcacaaacgaaacccggtgctgtcttccagctaggcagtgcgagcaactctccagcacttggccattcaacccggttaatagtactttcttactcaacatttggagtcctttctcactcatgtggccaagacgcttgtgccacaactccagggaatatccatctctgacagaattggtttctccaccaattgtctttccttgcatcacatacaaggaaccatctttctttccacgagccataaccaaatttcccttggtcagcttccatatactttctccgaagtagtttaccaacccggcatcatcaagcttgcctaccgagatcaaattcaaacgcatgtcaggtacatgcctcacatctttcaaaagaagtcggcacccgacatttgtggtcaggattacatcaccgacaccaacaatcttgctggtcacctgatttcccatcttcacgacaccataatctcccttcctgtaagcggagaagaatccctcatgtggggtgacgtggaacgaggcaccggagtcaacaatccaagtgcaatcatcatgggctatgttcaacattttctcactgaggaggaatatctcggtattcgggttagtagccacagctgtagtgctcgtatcattcttcttctggggaacaatctgatctggcttcacacagccattttgttcatcactttgcaaggtccagcagtccgacctcttgtgtcctaccttcccacagtagaagcacttcaaatcatgttttggcctagtccggcctctggacgtatctcgtccacctcgactcttgccacgaccccgggagtcggtctttcctcgattctcagcaacgttagcctcaaacgtgctggatacacctcgttctcttctcctggcttcttcattcaggaggctgtctgtcacggcatccatcgtcagttttccttctggaatcgagttgctcaaagtcaccaccaaagtatcccagctttccggtagcgaactcagcaacagcaaagcctgcatctcgtcatcaatcttcatgttggctttggacagttgattcaaaatacctttgtaggtgttgaggtgctcaatcatactcatgccgtccttgtattctagcttcacaagccgacgaaccaggtgtgctttgttcctgggagtcttcttctgaatcatggattctaacttgttccacaattcgtacgcgttcgtgaactcggacacgtgctcaaagaggcttttgtcaatatatttcctgatcgtggccacgaccttccgactcaggatctcccactccttgtccgacttcccggtcggcttcacttcaaggataatgggatcatataaatccttgcagataagatgatcctccatcatcgacctccaatagttgaagttatctgcagtcaacttgaacatatctccgtcgtgagttatgccactggtctccatctcgtctccttcagaaccctcgaacctgggctctgataccactgttgggtaatcacggaccctcaaatatcaaatgcggaagcggaataaaatcaaatgaggagcgagagagacaatcaaatagttttacgtgggagaaaaccttcttcaacacgaagaggaaaacccacgggaccaattccagatcaaatattcactataacaataatgggttacaatgaatcaaatacaccaatgtggtggtacactcaatctctcaaacaatggtgatcactcaaactccctaaagtgtttcactcaaactctctctagagatctctcaaatatgcacagcacaaggcttgctcaaatactgcggaatctctcacgcagtcaaatatcaaatggcggagtatctcaacgccctctcaaatatgcaagcatgaaggcttgctcaaatgtgctctcaagactgtcacttgaggctctcaattttctgtgtgttttgccttcacccttgctcatctatttatagggtgaaatggactgggctttaagccatcaaatcaaataagattatatcttatcaattaaaagatatctattatatcttatcaaataaatatcttctcaaataaatatcttatcaaataaagataagattatcaatcaactaaaaacggaaattatccaacacagccattatgttgagcagatagttaagtttgtggctatgtgttggcgatttcagggtacagattcttcaccagtttgctgacatgactaaagactatagtacacggaaatgttcaatgaattcttcttactctttacagatgagtagaatcaaccgcatcattcttgtttactcatgttatggcatcttattcatgccaaaacatgtaatgctaccacttatatttgttaaattgcataagctctaatttttttctaaattacataggattttcttttctcctaattaactctcattgcaggtagatttggtgtttctcgatggtctttcttcttgttagttacttcatcctttgtcaaaagacatgcaccttaaagttattgtgtataattaatcacaaaataaaattttccattttgtttctttagtacctaccaaactctcttgtgagcttgtggccccatatattgtcttgtacacaacacaaggagtcaagttataattttatttcattatatttccacacctaacaaactcgtggtctcttttgtctcacattctacaaaggataggaataaagctaagtatgtaactcttcagtaaaagtgtaaacccttctttctttctctcacagtttaagtgcatctttcaatatcaggcgaaaaaatgtttgaggtaaaaatatttttgcaaagaaatcacgactcttgtttttacttttattcattggattatattgcaatacgctacagtaatttcaactaaaaataaaacatacagtaattgttttaacccacttggcatgtatgaatctctgtgcaggtgttttgttccattctaaatggatattttttcattatctctttgaatttgagtagacaggactgacttttggtccactactttaattttcgtggtgccataagcagaatcaaggggaactgtcatggcaggaggtcgccaaagctcagaatatctgttcatccaatacttgaaagattttattatcattattgttctattttcttacgaacagaaatgtccagttagaatgctggtaaatactatatagaattaagctttctctcaagatgtttatggaagagaaacacctttaaagaaataatcactatgcacgaagcgatactggtgagatgtgtgcagtgttaatggaaagaaaagagaaaagtgatatgtgcgtacttttttctctagaagcatcccttatttatactgaacttacctctaagttagtttaagattctttccgataatcatgccgagatctctaacagcttgacctcacgatcttcctaataatcacggccgacatctttaactatttaaccttacaatctttactgttattatccacaatatccacgatctcatctatagttgtaatcaaagatatcatctaacaattattaattactaatatttagcttttaacaatttatttggatgtaagagtaaaataaggagaaaataaataaaaaatgcaaataagatagctgtataaggtttaaattgataaaaatatagctgataaaataatatcagaattaatagatttattaggataaaatcatattagattaaacggtaatcttataattttttatatatttgatattattgtattatgtggagatcgaatttagattatcttttatatatttaatatttattatcaattaaagtacacaaattaaatatgataagtatatacttatttcagtataagatagaattaacgtatctacactccaggtattatcttattaatagccaatagacaaatgtatcaatattaaaattagtattaacacgaatttaaatttgatacactgtttttttattataaaaaaatgcgaatacctagatatacatctaagtgccaaaataatgcacattgccagacaagtactaaagtaggtcgagttgtctctcattccaataaatttcaaagtggacgataactcccaaccacgaaaattaaaggagttgggacaaaaacatagtctcaatggactataaggacacatctcacctcaccaatagcaccgtaaagggaaaaaaaagtgtttaaatgaccacaaatttcacttctttttgacaccaaatgaaaagctaaccacattagacaaggaattgctgattctgctatgctgtgattacacaacacattagacataccaagtcaatgatgctgtaaagaataaactcccaagactctactgaacatcctatcttttttttgcaattgttcctggtgtcttaaaataggaagaaaaaaaaaaaacgtttactactttgaaggtgcgaatttatttaatacttttttaaactaattaaaaatatataatatgaaatattaatattttaattaatacattgaagatacttgttaatagtttttttcttttttaacatacctatttaaaaattaatactccttgttttcccctattatttaaggttttaatacacaaataataattatatttgtgcactcactttttattctccatccttttttatcacatttttcttcttcttattttttgtttcccttcactcatatacatcaaaatagagaataaatttattagaacccatacacaaatttaaaataaataatcttatcatatatactaaaattatctgtcaatttttttagtatatcttttactctctttttttcacttttacatttcatatacaattatttttgtctctcttttaataaggtatacttaaaaaaattgtaattaatattagagaaggtacagttttaaaaaggtgacatgtaaagttatctttaatcatattttttaattttaaaaaggtacagttttaaaattttaaaaaataataatcaaggactaattttaaaaaaataaatataattaatgagaaggtgacatgtaatttaattgattaaaaaaattaatagtatcaaaacacctcaaattattggggacaccgtatacactcccttaatattatctttaaatttttatgggacataaagaaaaatattttttgaagtgtgaaataaaataaaaatagagatggtaaatttttttagtagaaacaactaaccaaccaattaactacattggttttcaaaatttcaacatactcaatcaaccagccaatctgctaaaataaaggcggagtttaatcccccaagcccaggatttcaaatagattttttggaaattgaaaatagtgaggaagagataataacttcaacatcttactcagactaactgaattagatttcttagcttcacagaatttcaaatagtagttacaagtacatgaggcaagaatgattaataattaataatatgcggccttaaattgtttggttttttctgctgctgcagaaacgcttacaagttacaagggagctctaggaaaataacacaataatcttattaatctaggtgcatactatatattatatagagatatagaatagaaatctcatagttcattcagacttcagagagtggtttctaagttctaatcaaccctcctttggcaaacaactatttgtagctgttcttgacagattgaaccttagtagcctcttgtgcaccatcatatgacttgtcaacattctgattagtcaccccttccttggtttccttggccttttcctctgcaactctttggaactcttcagctgtggaaggtgccctctcttccatcaaacggttactacggtttccattgctcgcttgcccataattctgatactttcaataacaaaaaaataatacattactttctggtcactgtaacatgttgtcaacacataatagaatcattctttgagtgcatgtgtggattttattagagagttcaaatatgcttttacacttaaattaacaaattctacctttttcattttatatattgaaattcacaaatataaattggaattcacaaaaatacttttccaactttaatctaattaagcttagtttgtctaggttttaatccatttctcaagtctagatttccaccttcaagaactggattatgcaaaaaaatgaaaaccttccattaaatacatgaattctaccttctcaaacacatcaaaaagttaattaaaacttgtttccaaccaaaggcaaaatcaaactaaaaatgattaaaattccacgttttgttagtctaatttaattttctagtgggtgcattcgtacaaaaaataaaaaagtttccacagcaagtagataatgtaaattagtaactctagagcagagaagcaaattgaagtagaataacttggaacacgagtgaaagaaaaagaaaagaacagaacagagatttaaaaaggaaatgaaaataaaagggataccttaatggtgctgttgaagaatggcttactactgctaggctttaccatggaggatcttgaagtggcatggagaagagagtggaactgaccacctaccatggttcttccctctctctatcttcaggaaatgtttggctgtttgatagagactagttactagttagtataatttgggctctcatgtctgtttaaataaaaaccaaaaacaataaggacaagattactcctggcctcaaactcaatccagatatccatgtattgccctttgttaatgacgtaatgctaatccaatgaatctgtctagtctatcccacttattaatgacttataccaaaagaaaaatctccatcaatgactaaactgcattacacttatcacaaaattaattaaattataatttcaatttaatgattaacattaatatttaatttcaacctttattacttaagtatattgaaataaaagaaatactaacaacatatttttgaatatactcttttaaacatattctttatagttgactgaaatttattgataattacaaattttttaagtttcatttgttatttaatgactctttttctcttgattttgtaatttttaatatattctaattaaccaatgataaagtgtatgtgttagatttaaaacgaatgatttgctaacatttttcaataaataaaattgaaaatttactgactagattaaaaaatgtagttactaaagattttctataaaaaatatttatttttctctctaattatggataattattattattttttataagtattattagaaataaggataccatgaattttatttatcaaaatggaattttttttggtaagtttttccatgttgaattgaggttgaacaatcatttttaatttatcaacaaagcgtccgttcaagaaatgatcacatattttagttatatatgttgttttaatttcatcattagataatcaaattcaattttctaatatatcaagagaaataaattctttgtctataacttttttcctatttaaaaattcattgctaaatttgtaacatattaattgaatagtgtaaaataagatctcacatctaatatgtagtaagtgtaagctttcaaactcatctttttgttaagtaaaaacaagcacctttataagaatatttttatagtttatattgacaaaattactttcataattcaaaatacatgttcaattttttccccatcaatatatctgaataatattttttttaacaaaactaatttatttattttaatcaaaatttaatttaaaagttaaaattaatgtatatgtagtcagaattataatctttaacttattcttactttcctcattttaagaggctttcttcactttttcgttgggagatgtacttcacaatctttctttgtaattattgaaaaaaaatacagtaacttttcttatttatgtaacgaattgattttaaaaaatgaatttaatgaatagtggagcatttagtagaaagtaagttttaaatgaaaaattattgttaggtattatgagaaaggtagtactaacatgtttcaactgtgtcattaatgagtaattgattttgtgcattcattcactagttataatacattcatttattatttttaaggattttatttatttttaaaataaaccaaaataaaataaatgaatatatttttttatatgttattgatgtgaaatattcatcaattttattgatgactaattttcgaaaaatatgtttaactacttttgttgtgatcttttcttttatctacattttttcattcacaatatctcaaaactttacttacttattttgagtttaatatcactcaacccaacaatatattagtggaaaattaaagatattaatctataataaatatttatttattataggttgtgtttacaaaataattactaaaactaactttgtaaatgtttcataaaattattattgtgtaattattattaatataatgtatatcgacattttataagtattgaataataataaaacaataaaataaaataattttttataagttatttttttttttggatttaaagataaatgtcggaagtgggatttgaacccacaccctctaacaaacttgagttgggcatcctgactttgataataaaaggttaaaactaattaaggagttatacttttttaactaatatatatatatatatatatatttacataattaaaattagttaatttaaataattaaatatttataggaacataaaaattttaagaattatttttgtaacttccataaatgatatctaattacaaatttttaaaaaatatttacaaaaaatattaattataatttaactaattataataatttatgttcaatataaaaactatgggaatatagaaataatatgtgtgtatatatatataatggaattttttatattcaaagactaattataaaagtaaaaaaaatgttaatatcaaaacaaaaaatccaatcaattcacgcctttattaatccttttagagcatacaaaaatgattttttataacaccctaacataataattaagtttattttttgaatgaaatgttaattaagtaaaaactactgtactttttaataaccatatcaatacgacattagtaattaatactagttttttccaatatcaattcgaagcacagtattattggactagaaagtaggtaaccctgcttttgcgcaggaacatcgtcaacactcaacataggatagatagtttgttcgttgcgttgccatgtcggcgtcggagattcttcgggaactggatttgctgaaggacgaaaagaccaaaattgagcacaaaatctctgcgcttgaagctcaactcaaagagattaatctccaaaacgacgccgcaccaccctatgcttcttcttcttcattgtaccccaccaatggattgacccaggacatgattcacagatacagtcgccaccttgtgctcccttcctttggtgttcaaggtcttcttctcttcaacattttctatattcatttaattatcattcatgctacataaacctaattaagtttaaattaagaatgaaggaagattcatattcgttgcacgtgtgtgtttgagtattaactgtagttagttccatgttgcaactgctttatagtaacaaccttaacaattgcaattttgccatgtattgttttcactgcgaaaatagacattatagacaaatagcccttatctgcatgtttatcttgtttttttttttttttttttgtcttaaattttcccaccttcttgtgtttgtggagtgcagggcaggcaaatctattgaagtcgtcaatcttagttgtgggagctggaggtttgggtgctcctgcattgttatactttgcagcttctggtgttggtaatatatgacacttctaagctttgtttggataaatttttcataaacacttataagtgaaggaaataagaaagaaaaatgaagtcaccttcttgcacaagttaaaatcatcttatacacttaagcttttggagaagataagtgccaagttgattttaacttatgggggaaacttaatttattttactttcttattttcttcttgtcccaaacataacctctgtctatatgcttcttgaaacttacattttaaaaactatactcagggcgcttgggtgttattgaccatgacgtagttgagctgaataatatgcataggcaggtattgtattatctgttttaccttcccgccctcttttggcatagctggtgcaacacgtacattgtgaattgttgtgtttgtgtctggcatcagcctttgggcgtttgcacttttgcgagtacaaggtgttaatatgtgtcttgcttcagtgtttgtgttcgtttactatttttttaattaacttcactatttttattaatttggacaagttggtgctttatttcaggttatccacacggaagcatatgttggtaagccgaaagtgaaatctgctgctgctgcttgtcgctcgtaggttactttttcaccaaccattcatcacatcaatttttgttgacaaactgcaaataaaatcccatgagaaattttctttttcaaatgtttgttattgtaatatttgtatcatcattgttcttggaactaagatattttgaatattaggatcaactccactattcaagttgtggaacatgaagaagctttgcggacttccaacgctttggaaattctcagcaagtataatttctataataagattgatttttctttttgcttgaggcctctttcttctatacttacattttacatttcattttttatattaccactgactattttttttttttttgtaattatgtgaatttggtagatatgatataatagtagatgcaacagataatgctcctacccgatacttgatcagtgattgctgtgtggttctaggaaaggtaaatctgaatgttttgatgtatgaacagattgtgaccatttgaattgatgtcacatgggccttttcacttgttgctttaattttttggttcctccatgaatacactttctaagtcagcattatttttaatgttttggttcatcaatgcaaaagatatctacattaattcaacaaaaaggaagttatgcatgctcctatgtgcatgataccgataaaatatttcagtgtgtatgtgccatatgagttgttatctccaaaatctttgtgcaattgctcccagtagacatcaattttttataaatttgaaaagttacaattatatgaatttcttatatttcattccgttaaacaatttcgtttttggttcttattttttatacttatgtacatagtatgatttatgggaaaacttaagttacttttgcaattttttatattaactgttttcctgtgatgcagcctcttgtatcaggtgctgcactgggattggaagggcaggtatatgtctaattttttttcccctagcatttaagttgaataatgcttcatagtgcgacaagtactcctgtgtgcttgattatatcacaatttgaggattaaatattgaaacttttactgcagcttactgtctacaattacaatggtggtccttgctatcgatgcctcttttcaactccaccacctagaacagcatgccaaagttgtgctgagggtggagttctaggagtaggtaaaattactactgtctttgtgaactgtatcacttttacttctcattgctagtctgcgagacattttcattagcatgaacaatgtgaaccataagacaaattcttctgctctcctgttttcattgtgaagttcagtcatggacttttagtaatgtgtactataactattagtgacaacaaaaaatgattctgattgtttgattccttttgccaaaactgtctctacaaacggggaagtatctatgttttaagcaatcaagttttactgaaaaggaggtttttgcaaacaataagaaattcttattgtttaccggagagtgtactctttagtaagacttattggctaaaaattcaatttgtttggaatgttttaagttgtttcataattcgtttagctaaactgtgattattatcatccgtgtcagttattatgaatatttattgttcaacttgcattacttctcactagtacctttgtattttttgttctgctattgctatttttctgcttttctgacatttgctctgatcattttcagttcctggtataattggctgtctccaagctcttgaggctattaaaattgcagcttctgttggtgagccactctcaggaaggatgcttctcttggatgcattgtctggacggattcgtattgtatgttaagaactccaatgtctattaggattttacaagtggggcatcaaataattgtttgaatgtttaggatttcttataaattaggattttatttcgataaattacctggatgcaaagttagggttttgtatcctagtggtattggaactattagggtaaaggttttcctacttaaggatactctttagaggaattgattgacattactattgagtgattctcatattcacaccaatttttctgtcactaataataactgtcatgcagaccaatcattttctttataattctaataacaaattgcttttcaaactggctatcccaaattaaacttagacttgtaatatatacagttccaaatcatatttgtaattatgatgtctcaaagtaaaaaaattatattatggtttttgaggatgataccatagcaagatcttatttatcagttactgattatactttttttattacacaggtcaaaattagaggaaggtctatgcagtgtgaagcttgtggagaaaatgcaacatttacccaacagcaattccgagaatttgattatgagaagttcactcagactcccttgcgtgtggtatgatttcttttttttcttgcctttcacctcctttgtatttagatgaaattgtttgaaggtttagttgggtatatttttcatttgcactttgtattggatgagattgctggagataaaattcctcccaaaagactacaaaattgtctcccagtatatattattttgagattttccatgtcattaatgcattccattccatttatatgcagcctcctttgaagttaaatctacttcccagtgaatcaagaatcagcagcaaggagtacagtgaagtaattattaagaaggaaccacatgtgctggttgatgttagaccaactcaccatttcaagattgtatctctaccaaagtctatgaacattccactctcaacattagaggctaggctgcctgaagtatcatcagctttgaagaaagaggaagaggaaagtggtgcagtttctggatcaagtgcacaattgtatgtagtatgcagaaggggaaatgattctcaaagggctgttcagtatcttcacaaaatgggtttcacttctgccaaggatattgttggtggcttagagtcttgggcccacaacgtggaccctaggttccctacatattagctgacacgtatagctatgctaaatattactttcattaagttatactgcttgcttgaaattatttctccctatattttattagtgacgttgctttcatttttccatgtctatttataacattcacgtgacttttttttatagtcttaattgattttattcttgcttttgaattgttatagaaaaattgtagcctattcatttttacttttttcttcgcattgggtagagtttaaaaaaccacaggttattcacgttgttgctacagttgccaataatagttactttccattcctttcatcaaatgatgtttgctgagacaataatatcacatggaaaatactaaatgttacgaaaatttcattgtacgaatccacacaaatatacgtggctacaaattataatacctatatcggagttaaattaactgattcgtgaatttcatgtttttgtttttcgtacggtatagcactgctctcaaagtattaaatatccatcaatttagttcctattttattaacattcaaagactaattttaaagatattcgatttgtaatttcatgaaattattacgataataacaactcgcgccttaacatggatttccataaagcctgaccacgcacaaacacatagtcatatagaacaaaataccttgcatcacgtatcccaatccctactttgatattaacatatgcttaaggcaaccaagtcaaaaagcagcataagaatcataagtaaaacaaacaattctgcaggatttggtcgttctcataaaaggatcatttaaacgaagaagactactttgttagtttgcagaaatggaagcagagttcaaacacttagtctgaaggaagttaagccttgcagagacatgattgtgcatttgccttctagagtttcaacttttactcattttatatcagtagaattagatggtgtaagcaaagttgaatccagaatttgatgatatgcagattattccgtgggacacagaagcatggtcctgtttcttgttatggataacaaattaccaaggttatggatgttataaacttccacgttataataatttagattgtttatattataacttagtgactgtagcttgcactgaggtggaaaaaaacttgcatttcaaggaaattttactcatgtaaaaagaaaattttatttctccctctcactgtatttgtgacgcctaactacgcttggaaacacagtagatacatgggaaaccacgtccatttactaaaagacgcagaagcaatacctaccagctctgatctaactgtgaaattacgtcaacatgataccaaacatgctaaaaggcaaggaaaggagacaaagaaaacaactgaatttttttgacattagatcatcccattcactttgaaaagtgaatgcatccttaccaaccaagaagcaatatctttaagagagccatcctaatatatagaccattctttgcctgcctaaagtaagcagctcttggatctctatcaacttccactgtgatctgcatgaaattaagggaccaatttagtttatttaatcttaatgcttgcattcgtatcgggataacatatatcacatgacatggcaatatgtgcttacctcgtcaagtcttggaagagggtgcataaccacagcatgtttttgcatcacatttagaacatcttgatttacaatatacttgcctcttgcctcctcataaagttcaattttttctccaaatctttctttctgaatgcgagtttgataaaccacatcgcacttagaagcaacttccatcaaatcagcactttcttcccactccactccctttgatgtcagatagtcttttatgtcatcctatgaaaaaaaataaaaaattccataactcattttgtcatgtaattcccaacatcttatccttctcatgaaaccataattagtatttgcaacagttaccttcattttaaccacgtttggagagacaaaataaattttcacatcctgatacttggctagtaagtatgcaagtgagcgaactgttctcccattagcaaggtctcccacaagcccaactctaattccgtccagttttcctatctctctttcaatggtataaacatctagcagtgcctgagcagtttgaaaaagaaagagttttgaaacacaaaaataatatcatccaattaccacccaaactattataaatatagcaaaataaacaaacaataaataaaaagtcacaaaaattcccctttgtctgtattttctacaagaaaaacactaaagaagaatcaaacatggaatcatcttgtcaagtgtaaataaactagtaaaatatataaggtatgtacctaaagaataaagtataatcaaagaaaccttcagattgaaaagtccataatatattgttataattggctaggaaactggtgtgtactcaaaggaagctaccatttcaatccttgatagcaagcacctcactagaaaaatggaactccatttagatttatacttcaattggtttttggcacatttttggttaattgaaaataaatttcttttccccaagaaagagaaagatacaatttcttgagtcgaagtcttgaaggtatgtcccataaaagaattaattttatattcataggtcattgtaaaccccttctacccaatcaacttctcctaagaaattataaggagaaattgtggccctttcagtttcaaataccatgagacagcatcagcataataagggggtttgtttttaaaatttgattgggagtaatgagtcatggaaacaaatttgttaagtggattttccctgtgtttggaaatacgtttggcagggaacaaatcaggtcaaatcaacaaatgatgcaaaagttacacagccagtagcttctattcagatctcaaaaaccatgtccacgaggaccatgacacgttaccagacacacatagttatgcttccacaaaattgctcagcagcaaaagcttatctatcatagttcaatgctaattcatggttttaacaacaaggtggcagatgctacaaatgaaaatgaaatagtgcaatctctgcagtcaaaaagtagctaagggcaatagactcaagattactttgaaaaataaatcatcctatgataatatctacttgacattctatgtgaagcatcagaattataatctgtacctattgtggcaaattcctcatacctgggtgggatgctgtccagggccatcccctgcattgattacaggaacgctagcagttgttgctgctcttttggcagcaccactttcaaagtgcctcatcacaattatatcagtgtaaccttcaaccgttcttatagtatctgcaagaagtaaagttccatgaaacaccaattttagatagaataacaatgaaagaacccactaagtactaacaaaactttgcattgttaattgaaaggacataccttcaagcgtctctcctttagcagcagacgaaaactcccttgcattctcagttgtgagaacatccccacctaatcttttcatggcagactcaaatgaaagcctagttctagtggatggctcataaaacaaagtagccatgaggtaaccctttagcatttggctcctagatgacttgctttcaatgctctccatgctccttgcaacttcaaatatggcattgagagtctctctgtcaaattgctgagcctcaatcacatcatgaaggtgaaatttttgccccacagagaaggagggtgcactttcaacttgaagggcccccgccctccacagaatctcatcacctttatgtgaaagtttaacattttcaaagactcctgaatgcccaaatggtgtttttgactttaaatgatcccatggctgattgagcaaacagcatggagaggattttgcagccaccttgggatgagacacacccacatgcatagagcaggagaatagcaaagcagcagcactcattgtgttctattggagtacaagacaaagtgcttatatgttattacagaagcacacaaataaccattaattgcatactcaagtttcaaatccttcaactctcaatataggaagcaaaagggcatgcatgtaacttgaaaagatattggaaaaaaaaaacattaattaaacttgttttgagtggaatcacttttttctatgccaagaaacaagaggaatcacttttttctatgccaagaaacaagaagaatcacttgactataaatgtatgtgctttaaaaacatcgcttcagaatagacggcagaaaaattcggaccaaaaaactattgaagatgataacataggaaaaaaaaaagaggaagtatgatgaatccaacacagattttctagaaagaaataacgaaaagtttagagaagaaatagaataccgtgaggttatttgtggagagtgagtagttttgttaattttgaaggccgacaacggctacaaaacagcgttgcgaccgtcgtgcaagaaggaacaatgtgtgtaggctataagaggagacgacctggtttaaaagtaaacctttgttagggattgccactctcactcccaattttactatttgtaccctacgtgctttaaaaatgacattattccaaaaatactctttttaatgaaaaacatgattctattaacaaattagacaatgagatcatgtctccattatgtaagaggaagtgcaacgaaaaaaatattatcaacgaaatcatattttcattgtataattcttttgcactcttgtaatcaacaaaattatgtttatattctatatttttctttacaaatttttgttaattaattataaatataagttactttttttaagtaatacaattaattgtaatacaaactattattttttaattaagattaaattaattaagagacaacttacagtttttaatagtagtcaatgtcatttttaatagtaattaaattaaatatgatattaatttatatcataattaatttgattataattaaaaaggataatttatatcatcattaattcaaattttaataaaaaaggtaattcatatcacaattaattaaaaaaggtgatatgtgtaacgataatttgtatcataattaattcaaccgttattctttttttggattttctttttaaaaaagattagagtgggagaaaggaaaagatgataacaatcatcatttaattacaaattttcatatacaacaaatttgttgaattttataataaatatgtcaacaaacttttaattgatttagtcaaagattatttttaattcatcaatagtgtaatttttttatcttgtacatgtttattaaacttcaaataaatccttaaaatttataataaagaataaataatacatccatcaagagtataaaaatgttttaaattgtcctttaatcgcatgttgttatgataagtttattactagtaaatatcttaaaattatattatagatgattttaaatttggttgatcatataggagctaaacctattatactcaaattaaaaatgtcccgtggttttgaagacttgtttgtaatttttatattaaaatactataacaaaatttgcttaaagaattgttaaccataatgcagttctttaaaaaaaaaaaaaaaccataatgtagttgttcacttgttcaaacacttttcctgcgtatgtacgtgaaaaaaaagcaaactaattttattgttttggctattttaaaagaattaaaaacatgtcatttttgtttgtacaataaagttcataaagcttgcaaaatgttttgttagcgatatatgctattgaacacaacttaaaaaaatgaatgccttattaagatttatctcaaataatgaaagattataatatagtgattcgtccgatgtaacatccttttgtatgcatgacattgacgaaataaaaatctctatacctatgttgaatatgaaaacgatcaaaactacaccaatttgcaaaagcaattaacgagtcttatgtattattgttgcaatgctcattagtgtttgaatgtgaactccccatgacagatgttatagctgccacaagagggcagtgaaattggggtctgctgtgatagcagcagtggctgcatttactatgttagcaaatgatgaagttgtgtccattccctgagactcatgcaagccagcaagccagaaagcttagtttgatcacacagtgccagtccaaatatttttggaaatgacataaacttatgagccaaaagtgggaataagaggccatgttggccctgtggtaattcactttgtagctgtaaggaattggttgcattatgagtgagatccaatgtgatggtgggaaatggggctgaggtcaaagagttgccatgttctgagagcatggaagtgaagcactttctaatatgcttggattgattaggccatctgagcttggcattggtccagaaagaagcattgaggcagctgcatatgttgtggatgccattgcctgggctgtggatggttatgctgcccttcatatgttgtgatcagcacacttctgtctacagcacacctctgtacctatgaacaaacataaatccactatttggtaaaccttgatttctctgtataatactcatggagtttaacaaattaacacacacacacacacacacacatatatatatattataaagtttttgtactatcaattaatcaaaaataatttttggtatgatatttaagatatacttattataaaagtctaacaaacttattatacataatattttgtgattgagtgattgtataaaaggtgttgaattatatgcatatattatttattcatgttaatgttagagacaaaatgtatcaattccttcccaatggctttaatttgtagccattagctaactggcaaagtttcattacccctcaagatttcttagaaagcaccagctgatacaggctttttgatccctataacattcacactctaagctgtatatcattttccatgcccttaccaggcacttttgggtagcgtatgtccccaaaaaaggagagggatcgattggtaagtacaatagaaattcttgtataaacctaatatacttgagttgggtgtgcattactgataattaaagtacagtattattaaataaatcttttgttcactaatgtattgattataattcaattctttgttaatttagtgcactcaactcaagctaggtaaagtgtgctaaattatattaaaattttgcaaattaagttttaatttgtctttcccccaccagaaatgtcttgctagtttcctaataccgtaagagaatttcctccttgctttaattagctagtctcagcagaaagaacaatttaacgcaaattaaagaaaaaaaatttcctagcaagagtgcatacttgtttccttactgggcaaccagtactcattgtgcaacgataataggctcttggaaaaggatttcctttcgccctcttcttcctatactttcgccattggcatccatctgcaatctgtaataaaggattcatccaaaagaaagttaacacgtaaattttccatgatgtattttcaagaaacaagaaattaacgtgtgcaaacttcacattagtaaattacatcccctttccttagaaattagaagtcatcgattagctagctaactaggctgaatttgttaatgggtaaatcacatgatgttactatatattggagatgatagagttgcatgtcaattttactttatttatataatttactaaccattgaagaaaatcttgctcgaactgacacacgagctttcttgattgacatgatttttgaagctggatccaatctaggaactttgttactgatcaattcttggtcagcgtgcctcccttccatgcattctagctttaatttgcactttcccttccagcagaatccaacttatctgtctccaaaacagcaatatctttgccatgtcctaactcaaccatgcttttgcttcctctcagtttcccctctaaagattgctgggtatttggctcatcctcgtcagcaacatccatgtcttagaatgactttggaaccatatcttccattttccctatcactccgtaattctacacaaaaccaaataaaaaacaagtgcatacatgttttcagcattgaatatatgatcaaatgccagatctattttttggaactcaataaatttattaagatggatctatcaagtaaactcaaatataccactacttatttattaagttatttgatattcaatgttataaaaacaaataaataaattaccccatgactatgctgcttctgcgttagcttgacaatttgcatgcgtagggcattgcagttattgttcacctcatcaaccaacactcttaaaacttgattttcagcattcatttggtccaattcagttagcaaagctacaaactatacccataggaataaattaatattaattactatatattcatcttaaacgtgctacctttttgataaatataaatcaaacatatataacatatatacctagacacaacaaccaattagggtacctcgtagctcttatcgtccatagtttccaatgccgcatcttctttcgttgatctattgacaccagtatcattcttcgtaagaagatctgagctggtctataaattaacacaacaagaacataattaggtgcccatatatataattaaggtaaaattacaattattaaatctaaggaaatatttaaatgtgagtttggctacatatatagtacatacatcaacatgaaggtcctccacactttgatgatcatcatcaatatcatcatcttcactctcctttctcttctgagcaaaatcaagctcatccatgacaagtggtgtccttctaaacgacatgactggatcagaagaattactaccgttcacaatgggatcattccaagtgggttccatgttgattatatgtatatgtatatgtatatatatatatacactccctattatgttacgtagtgtgcttggggagcaagaaagtttttgcatgagtatcaaaaaggactcacgtagttgtgtctacaaattatttaaagggtgaaggaaaggagtgagaaggggtagatgtcagagatagatgcaagggagtcggcaacaaaaaatgggttttgactaaaaccaaatattatgtgtgagaatatataccaagatgcagtagtgatttcagaactgaggtaagatgcccacgtgagtgatttctaaaggagaaaccatatgaatggcaatgagagagactcttgacttagactaattactatttactagggcttgaaatgttccactatatgtaatttaccatttaaagattaacaattatatatatataaaaatgaattgaataatttattttattttattttttaaaataatatttataacaatgaaatatatatttgtgtgtagaaattttttactcatgtattatgaatttaaatcacatgaaagaaaaataaacaaccacaccataaaattagagatattcatggattgaattaaaataattttgaagagaaaaataatttagtttaatagcttcagttttcttaatttttcatttaattggtttaatttaaatcttaaatccagtttaatacagtctagagtgctttggattgaattttttttcagttgtagtcttactttacttttctataaataaactattaaataaatgataaaaaatattaaacataataaaaaatgatttttcaaaaaataacttaaaatgtcgttcaactataagtcattatatatcttagttaaatatattttttcataaataagtgtaaattatatgataattttataaatatataaaagtttagtttggattgcatcaacattgaaaaccaaaactgaaatctggtttaattcaataaaaaaattagttttttcgtttttaatttgttcaatttttagtttattcgatttattagttttgctttttcagttttatttagattggaccgatctatctctgagcactcttggataaaataataaaagtgtatatgtataattattaataacaaaaataaataaataaataaaatcttctataaaaaaatgggaaaaataatgggtcaatccattgaaattcaacattattttttattttacatgttttaagtttcaactctctagaggacactttaactcaaagatcctcaactaagtgtaatgtttatcgccttgtcaagacaattgatattttcattacagtaactgagtaaggaccatccatattccataacaaaagatgtccatcgttgacttttccaaccatatattgttatctttattgggtagagttgttttattttataaaaaaaatctaacagctgttacaaaacgttaatagtgatttagaaagaaaaaaaattattattttgaaacaatacattaaagtcaaccatgtaaaaaaatgcaaaccaaggagttaaatattattaaacaagggaatagataattttggttgccagttaagtggcattttttataacacgccttttctttttatgcttaacgttaagggttcttttaattaatagtacgcttttaacttatcaaaagtatttgtacaaactacaggacattaagccagaattcaaaaaacataatttgtgtataaaataagaagtgtttcgtttaccataaaatttctaaataaaataaaaaactcttattccattatgttcctttgcttttcatatccttcaaccaattcaaacagccaataaagcaaatgccgatgagagcatacatcaccttccaaaccagattataaacaagtaattgtttaaattgcaaattggtacgacagttgatagattcgctacactattgaatctgtcatatataagcatacatcattactacacgttgttctcctaaataaatactatatatctctgttaacactaattactaatcctaaatgtacataattatattatgtcaacatattaaatttacattatgcctacttgtataataggagcacacaatactaaatgcactctactgaccatcctgcatatataaccaatgctccaattgactaggtggggtaaccctcttcctaattaacatttcaacagtgggacatgttctcttccttcctcccctgggccttgacctgaactcttcatcagcttcttcaaaatccccctgaagcaaggaaaattatgagcaagtcaatgaaaaggcatgactatatgacaatatcacttataagaaaaccttttgcacaaagggaatagaaggggaaaagaacttacaagggtaaaaacatgtttagaagttttttcgtgattatctcgtacatgtttgtaagcaaatctcatgccacaatcaggaaaaccacaaacaaaaggcctttcattaaagtgcacagccttcttatgcttatcaagattagatttctgttgacataaaaccatgaacaaattaaaagaaagttcaacttgtaaccaaacagagaactcaattatagtatactctgattagatttaagaatgaggagtcttactcttgagaatgtgcagctgcaacccttaaactcacattgaaaggtctctgatgaactgccttcgacttcatgtgatcgaaggtgacgcttaatattcttcttcagttgcttagtcccacaaatgtcacaggtcatatattgatgggaggatttcacatgggcttgaaggcactggacattagcgaaatgtttcatgcaactaggctctaagcacaccacatctactgactccaacttaactgcagaataaaggctttcttcaaaattgcacccaacatctttcactaatctaaataaacaagaaccttacaaacatcccatggaaatttaactaactcaaagaattacaaaaggaacaaaacctaccatgagaatcttcatgtttttgtagctgtgatgcatatctaaaaacctttccacacccaatctcgggacatgtatgctgtttatgacttttgtcactagtagaggtagaactgttgtcatgaatctcctcaatgtgtcttttcatattgctttgcaaagagaactcactgttgcaattctcaacagggcacttaaaagtctttccttcatgctgaagaaggtgccgaatcaggtggtccttccttctgtaacttgcctgacaatcatcgacaggacacacaaatggcctctgtaaccattggaaaatactgttaaatccagaaacttacacacataaaggtatcatgatgctctgacaagaacaaaacacaaataaacaaactgccaacctcaatttcgaacagagcgtgtgaccgaggcatccttgatggagcttcacaggaggtctccctacctgatactaatccatcaagttcatatacgctgcctcgtgcattttggagttctttttctgggatccaatgcttcacactattaatccataattttccaatgattttagaatcttatagattactatcctgcaaaatatgtattttcagtctatatacaacaagtaacacaatcaattcacaacaccaagcctgtcttccacaaataaaatgtttctcaaggaacacgacggtctataaaacatacttagtttaagagtttcacttaactgaatctatgttttttcttaaataataacaatatttaattgaagagtccaaatacctcatttgaatgacttagcatgtgctgcaacaaatgggcttgttttttgaaagtggcaccacattcctcgcaagtgttggatttcgaagcctttccttcgggacctctttcagctcttgctttttcatcctcttcctaaaaacacatcaaaagtaaacaacaaaaccacacataaccctacataatgatctaattcaagcagggttgcttataaacggtttgattttgcagaattagaaagaagggtaccttgtggtgcgaattgatgtgggaggtgataagggtttttttggacctgcagatgccgcagtactcgcagaaatagcgtctaatatctttgaatttgggcctttctttagtttccacggattcacacatttttatggtgaagagataaagagaactattggagattgcaaatattcgatgcgctgatgagggttttccgggagagtgaggactgcgatgtgcgcggcggcgttgtgaagctacaaatgtgagtgagagtaaaagtaaagctagggttctggacaacggaggatttatatagtgttcccatacgatgtcgtttgcatagtttaatgcccgccaaataaccaactatttattaagttataatatatgataatactttgagtaaaataagaagataagtattttaaaagtgagtctaggtcttaaattttaaactgtccaaaatttccagaattttattttattttttcttccaaaagtcctaataatttactcacgagattataatattttgtttgaaatatatcaatttttttgccacatgaaatatgtccgacattacataattccttgatgttgtatttgattgataaaataaaaatagaaaagacaaaacagaagaaagagatcaaccaagtactggtatatatttgttttattttagtgatttgaacataaataggaatgctaaaaacatatttactaaaaatattatagttcattatatggttttaatattccaatttaactaatttataatcaatatattttcctgtagttatattacttgtttcaatacttacttttaccataccatcttaatcataaaatttatacgttatcgtaatttgcaaaagaaaaaaaaatcaaattttgcacgtttattattaatttttacctaaccgtttcttttaattttagtagactactctaaatattattattttattattacgaaaaattcaggatgtttccgttgtagcaatggactataatattaccaaagaagttaaagcaatacaattattgtcagccccatatagcttttacaagttagccatcaacatggctcgaattttggctctaagctcatcagaaacatcagttatttcaggtgattgagatggtgcccttggattagataatccctcagaagcctccctactagcacgtccaacttcaccacttactactgacttttccgatttcataattatctccccctcctccagctctctttctctttcagcatgagatctgctcttatgccctacacttctgcttctgcttcgatgcctatgctcaccatcagatgaactacaatcttcattagaatggcaagaatgtctatgctcatggtctgacaagttctcatccctatgtcgttgtttggaagagtggtgcttttcatcagaggagctatcatatttatgacgacgatgccttgggcgatgatgttcatcatcagaagaggagctatcgtgcttggtccccctgtaagaatacttgtctttggaggaggaatgtcttctcttgtgcttatgcctgtcccgattgtggtgtgaagtacgatgtgagcgatgttttttcctggatcgtttatgatcccttctatcttctttgttttcttcttcttcctcctcttcatgtctactagatcttgagcggtactttctttttgaccggcgttcattatcatcaacagtaagtttctccttagatttctgacttttatctgaattattatcaatagaaagattctcctcagacttttgacttttatctgaattatcaacatcaaatggaacagaacttccttccctttctttacccacaagattcccagtctcagcatctgaacctgaaactccagagcctggtggctcaactgataaagctcgtggcagttcacttgctccaacaccacttttaagcatggctgcaaacatctttgctcgtttcagtctctctgccttaagcttttgctctttagtcatgtgaacttcagaggagtccgcctcacctgctgctgccatagctactttttctgcaatagccttggcaacaggggcagaagcactagcctttgcctttacattcaggttttgactttcaacaaaaccttgtggttgaaatgaatacagactaccagtcccagagctggacaaatacccaccatcacttccaaggccttgaccactaccacttgatgtcttggtaagaacttccaaatggggagttttaatacccctagtggcagcctgaagaatagctgcagttgctgctgcatccatactaattgtgttttgagcttggtcttttggaattggaccttgatcatccttcttagacttgccaataatcatcttgaacttttcttttctgtccatgtcatatggtagatcagaagccatagatccatgtgaaagattgtcactaccttcatgtacagcagctttattgtcccctgtacgacctgctggattgtgcttctggtggcccttgcctagtaacttagactacaaacaattaggaagatcagtaagtagcagctcaaagtcaaaattaacactaccttaatcagtcccaaataattcatagaatacacaaggtgcaaaaaatccctccagaacccaaataaaataattaccaaaatttgaattccatggagaaggaaaatctttgaaaggcgaagttgaataaaaataaccatgactgcttcaaaaattcataatttatcacaactacatggcaaggcattatagctatataaagcatacatgccacatgcatacaaatttgcataacagacagaaatacaaacatgaccaatgattaattagaataaccaacattagggtactgcagataagtttacaggtgataatatcagtcaattaaattatgtttttgctttagaggggagggaagagtagggtagaagggaacaatttgaatcacattaattgaaaattaaaaataagctaaattttaatagttctgagaaacacacctcttcagcagtttgaagaactttcagatagtaagtatgatatcgattagatggcagaagaaatgggaaccttccatgaggtcgatcctgttctgccagaacagcctcaaattgttttccattttttaagatgaactcaactatcttctctatagctctctttaaatcagatggaggttcaacaactgggagttcaatcttagcagtactcgttacagaagtttgcgacttgttctgtgcattagatactgaatccaagccatcacctttagctctagctgtggttacagtcttaacagtaccaatagaatgattccgctttatgacaggaactttttctttcaaagagggtattggatttttagaaatgcttccatccttcttggccacatctgaataagattctgcctgatctattcctggagaagtataattactagcagcatcaacagctccctcacattcttttttctcaacatcacaagtattctcagttgtaccatcctcgtcctctccggatccatagacagatccaagcaacgacaatgcaccacctgtttgatcaagcccctgagtcctattcatgtcctcagttgagcttccatcatctttgtcaactttcagaagttcttggtgatcaacgagaaacctaaaatatgcatgaagatgatgatcgggcatcaggaatccaaaagttggattgtctccttgtttcaccctcagaatgatttctgactggcttccatgtttgctgacaaatgttgcagtccttgaaataatctgatgtactttctcatttggaggctggaaaagaaaaacaaacaaacaaaaaaatgtttcgtcatcaataaatgtgaattccaaaattagtacaagtataaacttaaaaagggtctagccaagcagaatatttagacacttgtatcctactaaacaaacacaagacaacctcacaaatactttgataatgataaagatcaagaaacagaactttatgaagacatgtatcattccatttgctctcaagaggtaaggaatcaacaaatttctatcatcctaatcccacctgcacggccccttctcatgacatcaaaaggaaccaaggtgcctgtgaatggctaccttgagtcacaagaactccgtttatgctccgagcatctgaaacttagacattgtaagccttagaataacatatgtaccctagacaattatcacctaatcacattggttaaacaatgaaaggtcaattaaattagtaacatcggaaaaccacacaatttaaagtatatattaagacagaggttactcaccaggttattgagtaggctttctggtactgggaatttaggatgaaaactagactcagtatcattgtcctttgtctccatggacacattagaatttccatatgaaaaggcgacagcatgaaagccagttgaactcactggatctgaaccataatctaaacacaaagaggtgatattcttcatcagaatcaaatataatataattctcaataacaacaaaaccatccagcaaaaacagtagttgcaacacaacgccaaacttaaattgaagccaggtgaaaacatccttacttgtattcagacacgggaaccgtagcaaattaaattccaacctgcaaatgtggagcttgttgttgccggaaaaaaaaaacactctgacatagactcaagtggaagttggattgttccaacatgcacggaaaaaacatgtgttttgctagccattagccaacaaagaacccacgatcaactagttgccccaactaaatgtgatgtctaaccaaatatatcaatgtgtcaaaatgatgagaacaaattgaacaaacttgatagacaaaccttagagaattacccgtgactgattattaatagcccttgctctatacacacatcacaatatgtcacacacaactcaaaatatcaaagccctcattgttacaaaaataaagattacgaaggcaagcttttttgttaaaccagaatatgttctcaaaacctttcatcatgcaaggaaacattctagctaaagcccacaaagaagcaacaaaagctttatcttaaaccgctgagctcaatcaaaacccatagtttcactcccaaagtttaaggacttcctcgaacctaattaaacagaacaacttccatttgattgacttttctcaccgtggcctatataaaattaggatgaaccttgaacactaacaaaacttcccaacttctctccagggaagaacataaaacctcatcaaaacaaaatcactaaccaaagctcccatagcttcttgtggtgaaaacataaaacacaacaaacaacagagttccaaataaaacagaaacatatttggggaaaatcaaccctaagaaagggaaggaactagaaagtaaaaagtatagaggaattgtgtatgaggttaccttgtggctgttcgtcgtcgggagaagaggaagggagatcgagatagcgctggtgatcgagatcgggttcgggcggaggagggcggcgcttgaggcgcggggggaggggagcggagagaaggtggcggacatcgtagcggtcgatggaaagagagttccattcaaccagagcttccgctgagttcacgaacgccgccatgccgtcgtcgtcgaacagcatcgcgtgccgccctgccacctccagatccatcgcttctgcaacttggttgattatcaaaacgcacaatctctctctctctctctaaaatatgaaaacgatgatgattatttgtttgtcgctatgggatttgaaaattatgaatgaacgaattttgggtaatgacccgtcggaatgtgccctaccggctacatctatgcacagggcccgggttttagttggagctttgggcctttggcccattcgtaaatgagttgattgtcggctttctgaaataattaataattaataacaatgtgtatattctgcttcaaaaatacaatgtgtataaaacttttacactctcatcagtatatttaagttcaattctaataattagtttagtctctcttaatgtagctattctgactatgaaactgatgtagttagttttaatcaaatatcagaattcgagaattctacagtcagatagagttttcagaggtcaactataaccaaaactacttaagtagttccactgccagcaagatgttgagttttgtccacactactaccatgccaatttatttagcgcgagacaagtttggtaaacgattttttcataaattataaagtaggaaattatgatttttatgtttaggatacgattaataaaaaaaaaattgtcagaaaattatgatttttaagaattaatttagttcactttcatgtcaaaacacattcttaaggtgggggacaggaatctaattttttgaatgtaaaaaaagttttaactacatattttacataaatatttaattatcaaaaaatatattaagactaatcaaatacacattcacacaaatcattattttatgaaatttacttttccagaaatcatgtttcccagatacaaatcaaagataaaaccataaaaaattatttaaaattagtaatattactatattagtcagattacaaaatggtgtgcacttaatcactattgagtagacatgataaataacctcatacttgtgagtattctctagaacttatcttgactttgatgaagaatatctactttaattacgtattattcaattttttaaagtaaaaataatatcaaattatattgtacatgtcactattacatttttttataattttttgtcacaacatatatatatatatatatatatacacataatattactaattttataaagattttattgttataattttcaaaaatataaatcaattaacttaataattaaataaaaacataattgaattctttattttttatcttttatttatttgttatttattatatttgtatattatttgaattaaaacataattaaaattttaatatataatttatttataaatatatgtaaattaaaattataaaaaagagtataacaggttatctacgatgataaaatccaatgagaatgtatgaaaaatttaaaccctcttttatttccgaatgcgtatcgcattttgcgagaacggagaggcaaatctgtccccgagcagcgccacccccattgccatctctaattaagcaaatatacctcattttgagttcgttctgcttatttagatagtatcaaagcttttcaacgagaactccattgcacatcgagtaattcttataaccaaaagcctcaaaacttcgacattagcttcaatagaaatctatcgtctgagtgactaatcagcaaattctagccaaaatcaaacgactaactaccatattcatccaaacaaaagttctactacgataatgtgacgctagatctttaatgtcgaacaataaatacaaattggtctgataaaaagaaagaaactatgaattcttttgatccacactttgaagctcaaggagtgatgcaacaatctgattgattattggattgcttacttagtagtctctgccttgatcggacaaaatgtgatttacatcagaaatccaagtatggcaagaccttgaatgtttctcgactctggctaacgtgcataccctctacatggtacgcacggtgcgaacaagaatgttttaaaatggttgtaccttgtgattttttttttttttttttaccgttaagatttaaagagaagagagtggtgaggcggtgatgaccatggaagatcttgcgttgccactgaccacaactttggagttttttcggtgcgatttcagcggcagatctgacgcttttattttattttatttagtatttaagttttgattcttatttatcgtaaatacttgttttatgtattgttgctgattttttgtattggtttctttgatttttttgtattggtttcttagatctgaatgttgtacgctatattcataagaaaatacatgttattatagatttgaatccgaagatctgagtttaattttcgtttatggatggtggttttatttatttatgtgggtgtgcggaagaatgatgatggagtgatggagggaagaggaggggaccgaagaagaagggtatttcgcaaaatagagaaaaatctaatgtagatagttctacagtagtctcatttattccaagatctaacggtgtaatatacacgcaccgtgcaacccattctaaaagtagtattcgcatcatgtatagccattaggggtaccccatgcaaaaagtcgccatgtttttcacatggtacttttgtttcgtgtatttggaacaacaagaactgtatgctttcaaaaggggatcgtcatcagtaactgaatgttttcactgaattaaaggtactttggagaattaataaagtgaactcaatccgtcataattttgttagatgcagttatgctagccaaaattaggttaactattcagttaggaggaaaatactaaggtcaatagtatactgtagaaaatttaactttatgccccgtttttagttcgttcacgatatttagaagtaatacatttgattcctagaggaaagaaaaagaaataataaatttgcaacaaataagccccctcgttcaaaataaagagaaataagagggagggaaagagaaaacctcgttccttacccacacggagaaagaacattttcaaaggaaaaaaaaacagagaaaaataaatagatgaacacaaatcatacaaaagtagacaccatagtccctacagaagttggcgattgcttgtttaatagttgaatggttgactggaggtatctgtctttggcactcaaacatgacttggcagtttcgaccagtgtaaggcaagcagacaataactcattgtttagctgtcaacaatcaagaaagaaaccattattagaaaactgaagtagaatctgcacatgattcagatacaactctgcaagttccaagcaaccaaattcatttggaatttgtggttacaagttacaacagagtatgataactttcaacaaggattcatcccctaacataatactaggtaaggctatgctaaaaatgaataattcaaacaagaaaatgttacgaattacaacagaacattatcatggggactcataagaaaacgcatattctgacttcctttttctgttccattcaatcattaggatttaaagataggtttaatatgtttgttaatccaacaaatacgacaaaattagattttaatccctaaaaaattataagttttggcccttatgaattttaagagttttgaaaatgattgattcctgttaccatttattgataacaaatgtatcgagaaagtgatcactgttgtggaatgcatagatgcatgtcaggccatccttaaataagatatatttcacccataaggccatacaagggtgaaacagaacaattttgttgaacctgagaaatgaagcaaacacgtatttcaattagttagttaggtgtctattagtgagggagtggggtaggttagttgggtgggctaccagggccgcgatagtgaaacaaaaaaggcatattgcctataaataataaataaagaggggaggttgagagaaatcatcttatcatttgagaaaggataatttgaatcttgaatatccagggaaatagctcgttttgtatcttcaaaacctagccaaaggctgctaccacattggcacagcaatcgtgatttagggttcatcaataaaaattcatcctttcctttataattatatactgaatcggtttctgacaggaacaaggacatttcatttgcctaccttttataacaaaatgctccaaactatattatataggtatagtgaacaatgtttattcataaatttctgtttatagttaaagaaatattaaataattaccatgaatgggattaatctcatggggatgccggggcagagaccatatatatacatacagacacactacaaaccagttaatgggttaactgcctgttgatttaaatacccatttgccagggtaggatgcctaaattggaaatagttttgtaatgtttttcaagaatttataaattgtaatctgagtcctctttttttcctttgtactttctccccacgtcaatgatggtgagaactaagttcaaaacaactacagagcagcttaccatgaaagatgatgcaatgcaattgcaagcttcaagtgccataattcctcgagcagcctttattttgttataataaatcagtattattataattggttaaataaatcaaacactattaattcagccaaaatgatgatacctgggaaggttcttgttgaacggcactaagcaggttttcaagaacaagtttagacaaagaaacaagctcttggttgtacgatgaatcctcatagtataacatgtcattgcctggaatctggaaaggaaaaaaatatattgttttgagaattaagatacaaaaaccataaaccataacatgtcaggaacaccttgatttacaaaaccgtaaaccttacacttgttatagtcagtgcaaagtaaagggaaggcaaattagattcactaacaggctcagaataattatactacattagcttaaccctagacctttacttatactggagctatgaccactaaatgacacttacatccactacttggacacaaaacaataagcaagacttctctaaatactcttcaacttcaatatgttttgtccattttggagtgaaagagtagatatgtcatctttattccattaatgcaattgaaaagaggaaatgcaaagctataccacttatacctgtgcatttgcatgatatggcagtctcttttgtgataaagttgtcaataataatatgatagcagaaaaaatttgtgtcctcatttttggttcaaacctgcaacggttttcaattcattcatcgaacaagatgcacgaagggagaagagagactaaaacaataagggaagtattttggggggcaagaagcttcgattgtgatatatcccaaagaaaacttaccaagatcgggagctgatcaatctaaataagctatttgggaaataggtgactggtagattaagagtaccttcaataaagttgaagaaaatcatagtaaatacatgcattcaaggaagaggtaaaaaggaactagatctctaacctagtacctatatatttctatacaaatcatagtaaatacatcccagaaagagagattttgaagtgtctatgtatattaatgtgcaaagctgaaacaatatttacaacctggaaccataattaagaagccacatagctttctaatagatgaaactagtccttcaacatcagttggagttcggaagcctacaaaatcaagcaaatcaacagtcaattatattataagaatgctatcgagagtacagacaaaagtcattttttagaaagccatggtggcacaattaatgtattttaaatacattaagaacaaaaaaatgctgatacaagcaaccaaaagaccaaagagaatgatgctcaataaaaacccctcgcaaaaatatggcaggtgtctttaacatattgtggcatccaattttgtattagttatttctaagaactattgctaggatacttgtattcaagaagagattagtgttgtttaaccacatttcctttttaagttctaacttttacgcattagaagccttgggtaacaataatatagggaaaatgaccctaaagtttggcactccaaaaaatttccatttcagttcgtatattgattgattaagcataaaactaatttaaccaaggatctacctattttagctctgatacatcattttcagttaactataaatatatattggattgctagtttctgactgggttaatcaataaatgaagtgaaatggaaaatattttcacaagttacacctacggatcatttagcattgcattattatagaccatgcatgtatataggttctacatcaacatcttattggagacttaactgtataatataacaatttccatgttagcttttaagctctatgttataagaagccccaatccttgttgggttttaggaatttgaaagatatacgaagttcataaatggcttcaaatcataagatattcgacgaagaggataaaagagaaaataaaaaaataaaaaagatgctcaaattattgtattcaaatcattagatactcaacaaaggggatagaagagaaaaaaaagatttacaaggttcataaatgccttcaaatcattagatatttgaaaaaaggggataaaaatgaagaagaaaaaatgcccaaattattgggctttcttcaacacaattgactgaactgagtcactaaaaaatataaaacaatttatagtttggacaacatgaacaagttttggttgtgaattgtgataattgttctcaaaaccttttaaccactaccgtttcatcatagcacatagaaaattagcattgaatagatttcacaaaatagacatgccacaagtaacaaatgacaaggattcaatttcaagtattggttcttagtactttcacaatgcatcagcaacaaatttacaggttttacatatcaactaaccatcaattatgtctaaggtatgcaaacagctgatcgctgaatcaatcaatccatctgaatgagaaaccaagccccctaagaatgcaacctgaaaaattcaaactatgaatccatgaaaaatataaaagtagcaaaaataaacacaactttgatgtgtcaagaactgacatacctacctctgcagtttctagaaaaagatcaaactgcctgtgagcataaatagaaggtattgtgacttcactaaatgtgacacaggatttgacaaaactcagatgtttcttatcacatttcaaagcttgaattgctaaagaattgctagagtgaacaagagtttcctgcaagaaagcatgacaactttatcacttataccagggcattttgccacaacttttaagaaaaacaaagacaaaccttaagctcatttaatctaccaaaagctcctcggcaatcaaccagaaatgctaaatggctttccatctctgttccatattctacctagtgaataaggcaatttagagtcaacattcataatcatggcaaaaacattaccacaactaaagaaagtgaccatagagacaaataatatcaaaaggaacaggttaccatgtgcacaaagcgagctattgaacatgccacttggccatcatcatcttttacgttcataatctctatattattatgtagtgtcagagaaatttcaaaaagcaactgtatgctcgtcggatcactaatgcgaccattcctgcttaacaaataataacagataattccatggtaatgaaatgaatacttaataaattatactcaccaatcagaaagatagaatcaagagtatgttgcaggcagctagcatattatgaaacaaaaacatttgaaaatgcaaaagtaaactctgtggtgtggatacatggttaagttttgattcaggatctggatgtaatttcccatggaacttttttgaaagaaaaaaatcccatcaattttaattgggtttcaatgaccttatttaatgttaacaaagctgactcaatgtcttagccttatagcagttcatgatttaagaaaatagaagttcaaataagatgtatttttcaaaattagatctaagatagtagacttggaagtgtaagtctgtataagttctgtgataacaattatctacgttagtgcagtcactttacagcagcttttatgtgcaagtacagcctatacaggggatttaggagaggaaagaaatgaatggttatatgaaattgtacaatgttagtaggaattttggtgtatttaatgcagcctaattttggatggtgagcttggagagaagaactcaacttttgagtggatttcaaatatcctgtgccaaaatgacttgtttggatatcaaatccaaagaattttaaaattgaggatatttttctggtaaaatgaagggatttcaaaatgaaaaaaaattgaaaactctcaccccaaaactctagtgcacactctatcactgttgcacctctctcccttttcctccctctctcgtatctatgcctctctctccttttttctctttgacaccactctctcttccacacctctctctgtctctccctttctcttcaacacctccctccctctctctcctatctctctttcgcgcctctttcttttctgcctcttttctccttttccccctctctctctccccctttctgacatacatcactttccctctcttttgcacatctcttactattttgcacctctcccctcctctgcctctctatttattcaacagtacggccttacaactcaaaagaaaatgttttttttaattgccacagaagtaaaggaatttgttaaattttaatataaaatcattcacatttcttcacctaatagcttaaattttgggtatagttggttcatcatatgatatcaaagcctctaatgaccaagcggtctagaagttgatccttgtcacactaattctaataaataaataaatgaatttcagcacaagataagtgaacttgcaatgttcacacttcaagccccacagcctctggcatgtggaggcatattagacatgtaatataaaatcatttatggtagttgttcatgacagagtttgtacacaaatatcaatcaactcaattaagtaacaaaagttaaaaattcttattcctcaaactctcaaagaacatacatatcatatacaaactagatgttggaaaactaccttaattgcggtcacccctagcccatctcagttgcagcctctttgagggctgcctgaattacagcctcaagggtgatggtttagtcccacatcgactagtgatatggacaagttaatgtaaataagtggagggaaaccctcaccttactagcaggttttgtaagacttagttaggctcaaacccaaaattctaagactagagaaccaaggtatgtcacatgggagtgtcaataagggtgatatggaatgaaaggagtagagtaaaacaaaatgtttgtgataaatggtaccttgtcgccatattaaggatatgcaaaaagacaacatcctgtgacttgccatacattacatctaagatttcaggaaaatgatcctacaaaataataacaacaaaaacccaaatcaccactagtatttatagcacatgtattgaagaatgaatgataaagaaagatgtaaaaagaaagatgatcaagtacaacaagatatgattaggaacataccagagaaaacacatcttccagatgcttaaaatgagacagaagcttcaccacaagagattgcaagctcgacatttcatcctctgtaactcctttattccaagtacgctttgaaatgccttccaaaatgattttcaaatggttatcctggcataaacaattgtatttagaggaaagattacaaaagaaaatattaaatattattctagtcatttgaaagtaacaggtatatcaatttgcaactaaactttgtaattggataacaattaatccatcaaggaccagagtttaaatctcaatattttctatggaatttctttaaattgtcatatatatgtttgactgacgatcgtctacttaaagaacataccaatagatagaaagaaagaatgcaaagaaaggaggataggctattgtccttgcacaaaaaagcttagaaacttagttccagaatttttagttatagatctcttgttacttttgggggattggcttgtacttagcttccttatcatttcagttcacagtacccttaccctattgactatttaatcaagacaagtattattggtaattcattcagcactaaggaatcaaattcactaccttcttgctaaaaacactttgccattaatttgttccaatatcggacatcaagcttcattcagaaggagcacgttcaatctctaggagattggaatcaagcaagttgtaaattaaaaagttcaaagcctgagatttagcaaatgggagttactgggaagcaacaaagcttgccagcacacccactcaacctacaaaactataatatgtcgatataatgcgtagatctagatgatgacgacacaaatgccaaacattggccttgtagaaaacatttgggtaatataatgttaactgcctagtcaagacaagcattagttgctcctaaagagtttcaaacctcaaacctctccttgctgaagacttacaattactcctacttccttttgtatctctttttttaatttaattttattaaaagaatttattgtgagaagaaaggatgtgattatagaatatcaatcaactgtgattatcaaattagcaacaaaaggataagaactgcattaaagcctagcttaacctttgaagaagttttaatattgatgtagatttaaaattgcatagatagccagaaaagaaagttgtgtagcttagaacatgaatcctattgagctcactaaattaatcaaacgtgcaccataaaaccaatgccttaagcagatagaaatttcagtgccatggtaacttggtaacatttaacacctgtttatcacagctttacaagaataattagtgccactgttccttaagcaatattgtcagttaaaaaatatctaaaccttagcatttaatattttaacagtcatagacataaaaagatgattactacaaatgcataaatttcagccaaaatcatctataccatgtaaatggtcaacaatttagtgcacccaagtgacccaacaaagaagatacataatggcataagaaacctttttcagaagacatggagaactaataacagtctgattctactcactcacttgaacttaccatctgattctgaagaataagatcagtataagcatctacaaccttcaggtatttgtcaaggctatcatacagagcaataacctaaagttgcagccaagttagagaacaaatgaaatacctgaaggaaatactgacagttgaaaacatgcttacaaatgaagtccatactaaatcgcacacattttttatagaggtaaaaattatcatatactcaaattgaccaggagtggagagcatagatgttggataaattaccaaaaaaaatatcttgatataaataagagggattactggtatgttaaaaattaaaatcggggagatttatgtataaacaagtcaaggtatatattatttataatatgctaaggggaagagtatatgattgtttagctttcaattaattacatagaaggctagaatcaaccctcaattatcaccttaccacgagaggaaacaacaaagaaaatacacaatttcccccaaggtgtagatggatgaagagatgaagatttaagaagaatatatgcaattgcaaagaacctaataatgtaactctgaaaggatgcaagatggactagaattttacaaatacctgaataactttatctaacacagcattgacaatatcaacagaggattttctttcgtacagcctgaatccaagcaatctgtaattcatatgctgtatcacaaaaaagaagaacattaaaaccgcaaatgggaaaaacttaaacgaagatgcctctataataaggtaaaatggtaaatactttataatgtgtacaagaagtatccagctatgatagaaattgcaaaagtatacctgatcaaaggaattatccttgctaaattcaatgagatgaaggatctgcacgacattagaactaactacttctatagggagttccttcagtaaatgatgaagaatgattgaaacactccccaaatccagttgattcttcatcaatccaaactctgataaaacttcattgacttgtctctttagcacagttagacatacttagatcagcataaaacataggatatagaggggagaaaagcagggaaaacattagcaaactgactttctttttcctactgtccagtttttgaaaagataacgacgacaataattcttcatgaagattaagatataagaattgagttttcattataataatgagaagaaccccaaccatttagctaattatatgtgcatacacctgtttcatgaaatttcaacctgcaattccactcccttgaaatgctcatggaaaattcaaaatagaagagcaaacatactaatcaataaaatttcaattatacacttttgtataacaagatatatggaaatatgatcatatataatacatccaaaacaagtatatttttgaagagaaacttcatcacatacctgagacaacccagtaaatatacacttcataatatactcaattgttggttccatcagactgacttgcaattttttgttgagtttaacatttttctgagttctttcattggctgacaagatttgcatcaaaacaactctgatgtcattgacacatgtaacaagatagcctgttccagttgcacaatttatgaaataagttttatgaaaataaacatgagaaagaagtatataacagcaatcggatatattaaattcagaatgagcaaagtcagtgacctttgcatcccatttcagaaaaggagcaagagaaaattaatcagaggcaactaagcactgctatagagcacaaaatttcatataggaaagagtatgaagcaataatctagattcattgattctgttttatctgaataactggtacaataatgtgttaaccagccgacttttcacattctaaacaacttttaaatttggaaatttatggaagaaatacaagaactttaaaccagagtatttgtgactgtactgacaccaaagagtatataatatttcacactaaggtcttggattacagttcataagggtgttagagcattatgataaacaattgcatatgtaaaggttagaccaaaatatatctaaatacatacagatcgtattttaacaattaaaaggggcccatctgcttcttgtttacatttttacacaccctaaggatagatatataatatcaacaaaaatacctatatcgtgtgaaggcagattctgagcacagtgagccatataaagacggcaatatgcagatgctactggatctcctaatcctcttatcatcattaccaagcgtcggaggctgtctaaaggttggtcaagcaaaaaccgccagcaaggcaatattgccagctccaagtaactagtacaatttcagataaacagtcagcaaataccagtcagtgagaaacaatctttagtgcaacagcttgtcaaaattcaaaatgttattgacaaaatctttcaaacttttctgaaaatatgtctatattgtagcaactttttcaagcaattttgacagaaaaaaaaaatgcttatcagttgtcacatcacattaaaatggcatcagaaagtctcgaaccaacacaagcagagagaagaaaaataacttcaggggaaaaaacatgtacggaataaattaaatacagggcataggataaggacttcacatgcgtggaagaagctcttgcacagcaccaattttgttgaaccagttatagcaagtttcttttgcatcagcacaaatatcccttgcttgaaagttttctacaagattcaaataaaacatttaagaaaaaagatgtgacttctaaaggaggtccatttatctcatgcagatcatcaagcttgtatgacatgtacaaattagttccaataaacaagatacaagatacaaaatgaaacatatttggtggcttctgatgtttgagatactgagaacctttttgcagttaaaacacagaatccttagtcttcaaaacattagcatgaaaaagatttaatgttgaaaaactattagcgccctcagacaagccacaagcttaacctgaataagtaatatttatataactacagattatggaagtaaacaacattttgtgatgagtttcaaattgacaaaggacctgctaagttgcagcgtaaagctccatcttcggaaaactcagctttccgctttatgcgttgccaaaccaggttcccaagcatatccatgatatctgtgacaagaacaaaaagtgtaggataaaactcgaatactgacgtatccatcagaagcttagcaacctgcaaacagaataatcagtttcagccctcataatcaatcaaaatcaagacaaacttagacaagaaatgaaaataaatcagtatgatttcactcccactccgaaactaagtataaaaatgagttatattttaaatgggtaggcccatctctctaagtccctagtattttaaaatcttgttaaacaaaattatacaacatttgtattctgtcatataaatattacgaagagtaaagaaagtacaggaggaaaagaaaatacaaaatggcatatccattttaaagggccgtcaatccctacactatctgataaaggggaaaatatattatcccagaaaaagggattatcccaggtctctcccacttttctgatgaagagcttcttcaatcagcccactcaatattccttcaacaatttactcgacaccctctcaaccccccaccttcacaattgtttccatctctctctccagctaaatggaataactaaaacaaaaatgtctcttttttcatttaaaaagccaaaaggtgattgcactcatacaaactataatgttgaaaagaaatcattaaatacataaaaattcacctttattgataactttaaggatgtcactcgatcttcagcaagccaggaacgagtaatttcatctttgagttcatgtagtcgagaaacatactcctgccaagtaatcgtcttgacaccctcatcagcaaatttttgtggatcgtccaattcctccaagtgcatatttgttgaagatttctcaagtactgaaaattgggaggtcacataactaagtaaagataaataaaggataaaacaaaaggaaaaacaatgtaaaagatattggcatacattttccacttctcattaaaacatcgggcatctgtaatttaaagaataaataattagataaatataataaaaactgaaagggttagagataaaggatcaaaactggtttaagaatataagggattatttacctatcttactttaagacctatcctctaccaatcaacattgcacaatagaaattacagatgtatattagtatatagtaattaactgctatatcttacacttcataagaatatttcaaagtttgtgaacttttttcaacagaaggttagctcatatgagcagtattatctggcgactagcatagggcccttaaaatgcaaaatcataaacaacaatgcccatacccaagcttgattcattatctttatagctgagaggtggaaaaaagaataatgaaggaacctaaggtgaaatatgagatgtattaataaatggttgaatatttagaaatatcttagtcaatatttatttttaagcacaacacgtattcacaactttcccaagtctgctcctgccagataatacacctcttccttaaaaatgtttaacgattgatatccgttaatgcagccgattaaaatatgttttaatcacatggaagccaataaaacagtatcagacagttctactgttttccaaacagaaaaatgtccagcctttccctagccagctaaaacaaagacacagaaagaatgaataacccttgcagaaggaggtaatgtccaaattcacactggttgaacttaacttgccagcagtatctaaattcacatctatgatctaacctgatctaccactactgacaattaagaatgttcaaagccaatctacagtgtcatcacaatgcatgcttccatcatatgcagcatactgtatttgcccttagccatcttagataccacaatatttttatttatttttatatgcagtatatctttaacatttacataaaccagaaaaagaaaatactgtaaaacttactgaagcaacagaaaccattttggagacaggaaacctctgcgttagtaatctcctgaaagaggtccactcctttgttggctgatgatcagcagcttcattcaagttgtcatgatcaggaggggcagcatttgcattattattagttcctcttagtggatcatagaaatcagtgttcccacgatctacgacatcgacctaaaacaaacatatcaacaaataaatgaatactgtcaaaagcgcaagatatgtaaaattttaccgttacaaatccacctaataaacacgaccacagttttttatatatattttcattaagcaagtcaacaaatattttcattacgcaagtcaacagaaattagtaagtcctaaattgtagttacttacgaaatccttcctggttcccgacctcccctcctttcctcagctcttagtgcactattgcagtgttacataaactactggcatgcaattcatgactatgattgtttgaataattatccagattacatcagattttacagaactaattacactcacattactcgtttcaacaatatcgaatcattagactatatcaaacaggataaaggtatctacacagggaaagatcgatagaatttaatttaactgaatgattaaaatcctaggcgttttcttatttcaggatgatagaactgaatcctaactctacgcaataaaataaaaaaaaaactgatatatttcgtggtgcatccgaaaccgtgaatgcaacaccgattctgcatagtcacaagcactgatcaagcaaggtagcgtaattgttttaaaagaagaaaaaacaattgcgagagaaattatgatacgagaaagacctgggagagaggtggaggtggaggtggagcagagagaggatgagctccggcgcgtaggcgagggagcgcgtgagattcaagctcggcactgtaatttcgatgtctgaactccatgaaagcattcagcaacgagagagggagagagagagggagggattcggggttttgtcttttgtttttttacagtgacttggacaaggaaaatgcaggatcagtgtgagaagaagctgactatcaaattaattattattatttttacaatttcatatttatatattaagatatataaatatcagtcaaaagaacttaaataatacaatttaaataacaaattacgaatttagggctatttcaaaattatttaccaacctgggcagttggtcacgcccaaaattgggcgaccgatttagtgacggaaaattcgattttttaaatttttttgtttgcgaccaaaataatttgtcggaaaaactgttagcgactgaaataaagatcaaaattggcgtgttttaatttttgacataaaatatcatttaatatcatttatttttatttttatttaatttgaaagtatttttagactcatcttcatcatagatatgatcttttttacttgtttttaatattgttttatttagtatatttttttaattttatatgactttatttaatatattctgaatttttggtatttataatttttagtatattattttatttaatataatttctaaattttatatgattttgtttaatattttttggattttgtatatataactaatatttaataaaatattttatttaataaaatttttcaaaatttttggattttggatttttcaatattttatttaatataatatttttggtatatataattttgtttattttggaattttaaaaaattgaaaatttttatttttgatacttctcattttttctaaatttttgtaaataattttttaatatagaaagcattttaaatagaatattatattttggtacttctcattttttatatcgagactaccccattaagcacattattctcatccctctcatcatctctttcattctctcataatttgataattctctttcaaaaaaagtagaagacaattctccttttctctttttgttccggtcaaaagcacaaagtcgactaacttgtcatcgaaattacaccgaaacttaggctttctgtcaatcggtgactcaattgtataaaattagtgtggtcaaaacatttacatccaagcgagaaagggaattagaaaggatcgtccatctttcatggtgaatgatcaattgtgcgagtaggttggtcaccatctttatctctctgggtaagcgcaatgcaattctttgcatttcaatttgattcacttttgtgtcacgtagttccactcctatttctagagttctgcaatgtttcgccgctccaagtgcgctttggaattaatggggtgctacaatttcgattattgtgtggtgagtgcactttgggatgagtggaacaagtggtaaagtgtggaatgagtgcggaaaagttaggaatgaatgtgctttgggataaatgaggttattatataaaaaatccaaaaaatattaaacaaaaccatataaaaatttagaatatcgaaaaaagttacaacggcgtacgatatgtccttcaaatggtctaacttttgatagaaatatccgatcgaggtgtacgatatgtcgaaatgctcgaaattaatagaagtaataaaaaaaaagcatgcaattaacttactgaataattaaaaaagcagaaaacaagaaaattttagatcttcgaagattaaatcacaattttgaggtacttagaggcctcttttgggaaaattttttgaccaagtcccctttgaaacttgccaggtgcttctcctctcaatttcgaacgcgtggctaccagtttcgcctcaatcggacatttcagtcaaaatttatgaccgtccgaagtttatatacgcatcgctgcatctgtgcatgacacgtgtcaggagtaggtcacgcccagaactgggcatgactggtcacgcccagcaccaggcgtgactatgcccagttctgggcgtcaccaactgccccagattggtaaatagttttgaaacagtcccaaattcgtaatttgttatttaaattgtattatttaggttcttttgccgaaaatattattagttgccgtttctgctggttgctgaaaaaattaattaaaatactttaaatgaaaatactttgtagattatgacaaaagtgacatctgttttccagattggcgacctaaatttaggtctctaaattacattccgatgattttaacaattttggtaattaataaatatttaaactgcttaataataataaaatacttatttattactatcaaaccaataagatatataatatttccataaaaatgtataataaagtgcaaattccatacttgtaaatagtataaaacacaatgtatgacaaaattgcatattcatattataataagaaaaaaaatcaagtgcacttatgaaattgataaaatgtataccaaaacataataaatgatagagtgcagattcataatattgaggtggtgtaatataagtttcatttgctcattttattgttgaatccatcactacatcttctcagttttctggtcataatttttgcataagttataccattggttcctcaagtgtcctctcctaatctcccttttgccatatatattagtctttttaccttttgtcacggtcatggtaaatttcatttacatattacccatctttctataaatatttatatagtaaaattgatgaaaaatggttcattaagaattgatggataatgtgttcactgggactaataatgggttacttctgtgtattgcaacacaaactttcgatggaagtatgaaacaaatgtgactgcgtcataaagtaatgaatataagaacgacaaactaagtaccaacaactttgttgtaattgctttggagaacttacgtaaaatagcaaaaagtgaagggaatttcctacaggtcacgtaagcataattttccaacttgtgtaaatttagtttatccttttttaaagcagaatacacgagttgtcgagctctcttccgaatggtggctaacacttttaggatctaaaggtagactcacttgtgacttattaaacgtgattcacgttaggtgaaaccctgtgttaccttactcgagtaatcccttgaagttagttgttacactctctttaccctttagtatataggcagagtctatgatttatatactttttatacataaggagaggaaatggtgtcttagttaagtatataatccaaaaaaacactaataaaaaacttacaattacttattaaagaatacgagtgagaagtcgaagatatatgacagcagtaagaaattccataattacattagtataatgccatgttggtagttttattctaaatttacagaagaaaaaaacagtagcgggcgtatgtttgtgtcagctgcgattgttctgagatcaaatgtatactatatatatatacacacacatggggattttgacatgttaccacttttaatagctattttattttttagatgcctgaataaaaagaaaatccgaaaaatttcaaagttcaaacaaagcatttctctaatccgggtcctgtagcacagctcttttcacattcccctaatattacctgtttatgcaaagtaattaattgtttttgttagaaactagaggtaatcatacttgagccggataatgaacaacaaagtctctatctaagcatttaactaactggacatacaggtctcaaattcaaaactacttaagctaaaataatttcgcaacaattgattcgcacagttagtaattaattagcacctttgttaaatttagcacactatttctcaaaaagaaagcgtgtgatcaacaaaaacgcacttgcggtctgaacgtgagtttgaagtttctaaattcttatcctctttgggaagtatgccagtactaatcaatccctttgagagactaataaagagcaaaagtgactctgcagcaacccagcaagtaaaaaacatgacgcaactagctgtactgtattaaacaccatccagaagaaagaaaaccccttcataagatctctctatgcatcacattttcccaacacaaagaaacacatgaagagacaacaaaaaaacatgccatcttcactcaccttaccattaaccattttgacagtactgtcttttctctccttcgcccttggccacgatgctcaaccctgcagtgaagcgttcctcaaactagcccaacaaaagaacatctcagcctgtaagacactgcgcactctgggggcagagtttgcttggtcctaccacagtctcaccaatgaatccatagaactagaaattatgttccgtgccacactccccaactcacaagggtggatggcgtggggtgtgaacccgggaaaaaggcctgagatgattggaaccaaagccatcatagccattaaacatggcgacggaacgtggaaagtagacacatacaacgtcaccaaagagaccagacacggttgcagccttcttccgtcgaaaatcgcgtttgtgaacaacaaatcagttgaaaaggtcgctaatatgaacaccatgtatgctacattggtccttccttctgatgtgtacaacgttacgaagctgaaccatgtgtggcaagttgggattgacattgacgatggacatcccctgaaacatccaacaactcttcggaatgtcgacagcacagaggtcatagacttgactgacaaaaacggtcgcagcactggacagtaccggagttatcttagatcggtacgcgagagctattttttttttattattctttgattaataatgcttaggtaaagatggtcatggtctttgactttcgacaaaggtatacctggttcaaaaaaaaatgatcatgaacatatgtcatcatttcaatagtaaatttaccaatcttacttgtctttgatccaaatcatattttattttattggtaaattaactttttggaagtgtttgtgtatggtaagtgttcattacacaaagagtggcaaaatggcatgactcaaactcggttaggccgaattcactcaataaaatgtagggagacctttaaattttgaatctgaattaaaatttatatcctttagtgtaattcgatcatgatctaatgtaggctaaaaaaaagtctggtgtttatcaaatttgaacctggttttagaagtttgaattgaatttggatcaacatgttaccattaactattcaaagattcactagtatttcaatgaaaattaggcatgtgaaactggtaaaattaaaaaaactttaaagatagctagatattttcaagaatattgaatttgttctgtttatagaagaatggcaaattcaacttcccacatgtctaactactaattaattaggtattagattgatatacatttttctttttctaattaatagaatcactctggtaaatatacctatacaatcgaggtgatcattgttacacaaataagaaataaacaacaggattagtctcatacgagaatgattaatttctttcctgtgtgttgaagaggcacatttaatttatacttatggttgtgcatgaaattaatctaggtacatggagtcctgaacattatcgggtggggaacactgttgccgattggaattataactgcaaggtactttcgggtgtttcctttcaaatgggagccaatgtggtttaacctgcacattggttgccaattaactggttttctcgttggcaccactggatgggctattgggttaagtctcggccattcttcaagatactacaccttccacactcatcgaaactatggcattctcattttcacccttagcacagtccaggtaattaattaattaatatttctttctttctatatatatatatatatatatatatatatatatcatgtacctttacaatatcaaatatcatcataaaaaattagctatttaattatctaataaagcgaatatagattatacagatatataaaggagattgtagatggatagtccgtttagggtacgtgtgggattaatatataaataggtctaaagggaattaaaatatttttttaaaattaattaatataagaagcatacttttaaatgatgatgaaaggtctatgttttaaaagagaaaatcataatagattaaaaaatacttttaaagaaaaaaaacactaaaaggaacctatttagatttaataattaattttttaaattatatatccctcaaaagcatgtgctttcacccttggttaagttgtagatccattccttagtaattaggtttagctctaaaatatttaattaatatatgctccacatatgttttaaaagtttaaaatatgtagttaatttttttgctttctaaaatgcatttagtataagaatttttattattattgaatattcgatagttctaccattatattaccaaaataatataagggctgaattatctgttaaaaaaattagtcacccactattaattttctaaccaacaattataatttatagtatttacgatttacatcgctaaatcctattcatatatagatttaacgggggaaaaaataaagaaactgatttaatttcattcttattaattgcattaattaatctctattaggatatacattgatgaaagatatgtgtttggttttcagatgttggcttttcgcttgaagccgaaggtgacggatgattaccggaaatattggaatatgtaccatcattttcttggttatggattgctggctatcatattcataaacatattcaaaggaattaccattttggaaggtggagatgcatggaagtggggatacattggaaatcttgctttgttgggtaccatcgcatttggtttggaggttttcacgtggattagcttcttcatgttgaagcacaagcagggaaacaaagccaagaacaaaccagagccagaagcaaaagcctaatatatatatatatgtgtgtatatatatatatatgtgtgtgtatgtgagtatctatgcatgagcattacagcacgcgtcgaatatattgcctcaataatgtgtttttttattttttttggatacaataataatatgattgcattttttgattgaaaaaataagtagacattgacttgtgcttgtgggatagtaatttattttcctttttaggttgtttcattattattatatcgaacaaagaagacgagttaagaatatataaatatatatatatatatatatatagatcgacctcttaatatatgtcattattaatatctttttatttatattaaaatcacttcttaatttatttatgttttttatctgttatttttattaatttcttctctattttataagaaatgatatatttattatgacatatttaattagtcttccaaataatttttaaataataaatttatttaatatttcaaaacagaaaaaaagtatttaataagaaaaaaaactagaaaatcagtatgaagatgttacattaaattataattaattaaaaaaatgtgttttgctatctccttgtttaagaaattatatcatttcttcgtaatgagtttgtgtgcgtgtacatattaaagttcgaacctagttacggctatcaccttatgtgtattatccaaatctttcaccactagtctttgtaacaagtgtatcacatatgatcttttgaaaaaaaaattatctctttcttttgataaacttacaataaggatgaacaaattcatatgtttagaatagatgtaaaatgaataagatgtatttagaaattagttattttaaaagaattcttcctaaatatataatacacatcacattctattttattttaaaattgaattaattttataagtttaaaaaaatttaaagttagaaatttctcaatagataatattgtttcatgatcaatatctaaccaaaggtcaactacattaccaatagaaaagatagtggtagttagtggaggacaaaataagttttggaatttattatcattctcccaaaaggatatcgataataatctcttaggtactgaaagtattaaaaaaaataccttttgagcactctacaaagtatttgaaattcgagaaaaaaatatcattcatataatatttatttttaaaggagttgcaaatggattcgttgatttctcaatcatggattggaactgctaagtccacattacagacaatattatatataattattactagaaaacaaatataaaagaatgttggaccatggaagttctccataataattgtgactcgttcccttaatcaatttagcttttaatataggatcattcaaaatatatattttattcataaaaattgaagataatataaaaaaaatttatgataaatcacggactctgtttaatcaaatgaactaaaccccttcacataaatcaaaatatttgaaggatctgttttatcatttgtcctaacaaatttaaattatcagctaatatctaaatgatcattgttgaaagataaatgaaggtaatttattaaaaattaaaatcttcatgtgactattaattaatttttaatcttaattatttaaggttatatggctcaaatttatatattttattcttaaatgtttacactaaatatttccccttcaacctttttcatttcataacatatttttttatatcattttttttcttattcatttttttaatttccttatctatccgtatcaatatttattttttcaattaacattaaatctttttatttcaaaattaaaaattttaaacatatatttaataatttattttatatttattactaataaaacaaccattctttactttttaatttatattttcacattttatgtatacttataaaaattaatattttattaattaaattcatgtttaaaatttatcaaaattacaaatttcaaacacatgtatttttattttttattatatttattattgataattatttcattaataaaacaattattcatttcctttttaagttatattttttccatatttgatgtatatttattaacatatttttttaataccatgtttttcatacatagatctatctaatttgttggtgactaattttatcgaaaaactatattgactacatttattgtgtctttatttcttatcaccttttattgtgtcatgcattaagaacctgtcttccagccgtgttaagagatgctacattcagtagttgccttcgtgtaagtgatattattagtataaaaatttggtttaatcaataagattgaagtgagttgattacgtgaattgaagattaacaatagggcattattcatggttttaggatgtttacatttttttatgttctgtacttcctcaagcatatacacgtccatctccgcaacactcactctcaccctgtctcacttcaactcactttttccaagtccggtccttccggatttttttttataaccaagtcaaattccttttagaattgcgtgtttgggtagataggtcagtagaccggtcacgacatcttgctcttattgaataggtgggacatatcattttgctctcattgaataggtgggacatgacatcttactcaagacattctaataatatgtactttaaagatgatattatcaaactaaccctgcatcaaaattaatcattccaaactcatagttagattaccttacctgtgataggtgttcaagtatagtataaggttatattatgtactcaactgaaaaatgagaagtgaggcaatgaaactcccaacaaacaacatcatccaaccaaaaactagtggcaggaactaacgaccacatagtcattgtcccatcttccacgtggatctattatcatgaacgatgcattccaattccttatcaccccaaaagtccataatttatggaaatcaaggtataattttcatcagcactaaaattgagcttcatgttagtggcaaacttatcggtggaaggcaccacatgagggagtttacgcaagccaatcttggcagcttcaagctttgcaagatccttttgagaagaagaggaggcaacaaacaccttagcaacacttgcatgtccttcccttgattgttttatatcaacatgcttccccttcttttggcacatctcatacaacatagtcactggttgaggctgtttctccaaagcatccggtgtcactattggctccaaaacacccctcattatctgccacaatcacaattattttcacaaaccattttttcatcatcttgaattatacagcaacttcaatgtaaaagtaaaagcttattctaaaaatcatttataatagttgtcattcattttcatcataatgaattgattcagcactgcaaatgaaattaaaaaccttgcctgataatcacttataatacttataattcgttatcatcgtaatgaattgattaccacaaaatatgtttcgatttatactaatttaagcatacgattttaaccaatttttgaatgtaatcctaaaaatactttatcatattatgcaatacaattttaaatatattttatattatgcaatacaatcttaaaaatattttatcctatttttgatacaatattaaaaaatattatatactatatttgaatacaatcttaaaaaatattttatgtaatcttaaagatttttattatattatcttatgtaatacaatctcaaaaatattttatcttttttaatataatattaaaaatattatattttattatatcatatgatataaccttttttattattaaattacttttttaatttttaatattataataaaatttatattaataaaattttaggggggcggtgcccaccctagcatgggcggacgcaggctatagattgggggacagtgccccccccttaaattctcaagaatatgtttaaaaatttttgggtaatttttttataataataaaataaagtaaaataaaaaaataacttagatgttttcacaaggagaaattgaaaagtatagaaaaaaaataataaaaaagatgaaaaataagagatgagtgagtgtgaatcggtatatttataattttcatgaatgcagtgaccacactcttgttatttttaagcaccagccacacactaattttttttctggatccgcccctgcaccctagcccccgccccccttatctccgcccctgtccgcaacactcactctcaccctgtctcacttcaactcatcgacaaacttttttccaagtccggtccttgcagatttctttttataaccaagtcaaattccttttagaagtgcgtgtttgggtaggtatgtaagtaggtgggacacgacatcttgctctcattgagtagtgggacacgacatcttgctctcattgaatataactacacaagacatctttttgtagcaaaggtattaaaataaaaaataatagaacaatctaaagaaaaaaaataataaaataatcaaggataacaagattaaaaattatcaataatatttttagaaagaatatttgtttgtcttaatcatttgatttattagaagaaaggaactctaattatttgaagatcgatgaaaagataaatagagtttgatcaagattttttttttcaaatatcaaactcagataatccaatcgaatcaaccttattaagtttgccattactgaaacatgattccagtattgtgatgatgggagcggggtgtgtggggattttggcggtggttctgagcgaggaaaaggccttggctttgggcccagaaggcccacttgtggaagagttctgggacaccaaacattggaagagtaaaaattactatcaaaagacaaaacatttttttataatcaattgatattttataaaattactttataaaactagcttgaacacaaaaaaaaataaattaaatgtatattaatatatatatatattttatttttttgactttgaatatattaatttataaattattgaataaagtatatttgacaaacaatattaatataacatttaatattatcagtataatattaatataaatatatgaataaatagatttttcatatattttatgacataaatttgatatttaattaatattctataaaaatatattttcaaaaaaagtcaaatgaataataataaaatattcagaaataggtatatatattatatataaataaatattaacggtcatatagcaaaataaatttatgaaatttcaaaaagtattaatataaattactttattataaaaaaattaaaaacattaaaatatatatatatatatatatatatatatatatatatatataatatacccgtacatacatgataacagtgcgtgtttgattaggtaggtcaccacatcttacttgtcacaagtaaaacaatttttgattgtttcttcatttttaattatttatcataattttttagactaaaatcaattttatttggaatccaaacatgcccaaaatggctcttgattataaaggcggataatctttatctatttaatgtagaaacaatgtacatttaagtaactttacaatgtagtttttattcttaaaacacgagtgacattatgacttttattatgtggttcactgttttaattacatgtgaagtcccagcttttattttgtggtcgatctattgctttatttacatgtgctttatcatttgacatgtgttccacctctgcaaggacctgccaagtcggagttaggacttaatcatcttaatcattggaaacttatctcaacataatttgaacgccttgcaataaattttataaaaatgatggcaaaattttcgtcttgaaaaaaaaaattgtttagttataaaaaaacatgaataaaattccttttaaaagaaatatctttggcttagtagggcaataacatataataaaaaataaatgaatatatgctgctggaaatctaaatacgcaattatttatataaaaataaatatgcttaattaatcaaacaaaccaataatagttcaatggctacataaaataagggatgtgcctttatgactctaagatacctgatagacaattataatctagttccaaaataagatatcttaacgagggcaaatcaagtagtggtaaactaagatattaatgtaaatttaaggtttcaaatatttagaacctaaataaagaagttgaagttgttcaaaatattacatggctactgaggccatgagagaacaagtatatatacatgaatcacacttaaaacaactaaacctcattcgacagggcatcttatccttctctatgttgcctggttcaatgcccaaaagttcaggtggattttttttcctttttttaaaattaatataaagaaactattctatgtatatatatgtcatacttttaagcaattgattgtgaaacatacataggaatgttcaagaattttcttgatcctccaattcactttagtaaccacattcatcctcagttaagtctatatgtttatcatgaattaatttggtcatgttccccctcctctaaactttggtcattaattaatttagctttagatatgcatgtgatatttttctaatggtatttgttttctcatatgtaggtcttaaactgttctaattaattattttattttcacttgtatatgtttgactcaaataagatgttcggtaaactcaaggattataaaaattagaggagacattcaacggcctcccaccatagacaaatccatgtttaaatagtaacacaaaaaaaaaaaaagattaaaacgaaatttaagttcatggtatctagataaagtttaggaatcaactaggataaaattaaaatttaatatgtctatttgtagaagctgagataaaatttaaggtgcccaaaaatactctttttcctaaaaatataataattaaaagagtacattagtattttttttaatgttagtatatttttaatgtaagggttagaattttaaaattctgactgcacagttaaatccaaaatattgaaaaaattaggaataattttttaatttattttatggaaataggacaaacaactatattaataatgattttttattctcacttgttaatattattattttaattaatttaaatattagaatttatatgttgtaaacaaagattaaaatttctagcctaggattaagaattttttaataaactttcaatatagtagtatgttataagtggatgactggatggttaatatatatgtagttcggatggtctccaactctcccgcatttcctgcataattttttttcatcaaaatctcaaccgaacatcaagtcatctctcatctctggttagtgtagattcttccattcaatgggttcatatgttgttaaatcgaaaaacagaagttttgttcattgtgcatgcagcaggctacaaatgatcagcatgctaaaaatatacacaagatcatccaatggattttgcttgcacacacaagacttgtctcttttgcttgcacacaagacgaatcttttgcagttacttaatttagactcatatgcttgcacacactttgagtaagaatggatatgagttcttcaattgtgctcgatctccattgttatatatattttaaataatgcatgatgaactcaattatcaattctattcttgtactccacacttcagaaaagaaaaagacaaatctttgatgtgagaattgtctttcttcatttatttcgatttagttttttgttgatatatctagttctgttattttattcagtttagcttgcagttttatatatgggctcctagcaccctttttctcaccaaaaagccatgatcgtacgtgattatcttatacattttattttctattatttcttcaaatactgccaacttgatgtgattgtggaccttagggatgcgaatggaaggtcgaaatctatatcttagttgtaagtttttaccttcatttattgtttagactttagaagataaggttaatctttactttggaatttagttttgtcatatatctgtcaatgtttttgagatgggaccatgaatgaatgaaactaatatgaaattttggttgtctttgaatatgcaagggagttgaagaatattggtgaaaataaaccatcaaatgccacacatatcaaacgaaagtgatatttcaagcttgaaggaacgaaagaacattttgcattttaattgatgataactactccatcatcatgtataattaatctttaaaaaacgtactgtatacaatttcactattaaaattgttttactctattaccaaaaagaatggtaaacaaacctaaacatttaaaaatcattgtcttaagaaatacacagttgaaaatatggattttcaaaattgagattggatttgggtgcatttgatgcatattaaaagaagaagaatagcacactataaggaaattaaatcacattacaacattttgttataatgttgtttggttccacacttccacttacaacacaaacaattttatatggattcgacaatgttccttgttttcaagaatttgtcaaaattgattggtattttttattagacttaaatatttttttttatctttgatatatattagtagttttatgttcccgtcattttcttgttttagtctttttcctcctcttttctcccttcttttattttagctttttttctctccctttttccttatttttgatttatcattggattcatctaccattgaccccaattaagttagattaaaggtgttgttgatgttgatgtatatgttccctgatatttgaacatttttattttagatctatgtcgttagttaagtaataacgtgcactttaaatatttgataagacgatttgtgatgaatcaaaaatcgtcagtatttgtttcaaaatcaaattaaaatttttttacagttaagaatcgtcataataattaaagtaaaaaataaataaatcaaacaacaataatttggtcctcaccattagcgtcgatgtcgacttccaccagtgcaacaataattacaacatggtgggaaccacacaaatctagatttggagcaacttttgtttgtcacagcggaggaaaatgacagggttgaaggggatcggtcatcgccgcgaccttgttgaagatctaccatgttgcaccacacgaatccagatctgccacaactttcatctgccgttgcgaaggatgatgaaggggttgaaggatgagtggtcattattgcttcgttgtcgaagttctgccatatcgtgccatgaatactaatgtggttcttaccccttcattggaatcaagccagcacgcaacacactattctatgaatctcaattttgtgcaaacaaggaacccttcttgaacacccaattgaagtcattgctagaattcttgactatcgaaattgaaagggcaagctgccattcgttcttcaaaccaattccatttgtaagagcatgaatcatttttattccaacacaatactcaaatcgtgcctccctcgatggttgtctcgatgggggaaggtgtgtacgggaatttgacacgggagatttggtacatgcgactgcggtggcagatgcccacgatggtgacaaagtgagggcccactacggatcgacatcaatggagacatagatgacacgagagtggttgaaggtggcagaggagaaggtggtcacgaaagaggagggagaaggaatgaaccttctcttttaaaaaaaattgagatctattttaaatttgatttttaaacaagtacgatgatttttgattcactacttatcaaatatttaataaacacattatcacttaatttacggtagggatctaaaacaaaacttttcaaatataaaggaaaaggaaaaaattatcaaggataaaaacatagttaaacatttttactatatgagagaaaaagttagccaataagttatcagttaaccaatatttgaattatcgtctaatacctcatctttagttttgtaatgcacaacctatgctcttttttgttttgttcttttaaggagaatacacactatatctcattcatccaggttatttaattttataattaaaaataattttaaatgtatttaaacaaatcaaaaccgttcaaattcaaattgttggaccattcaggttctctataataattatgactcattcccttagccaatttaactcttaatataggatcattcaaaatatactttttatttgtgaaaattgaaaacaatataaaaaatttactataactcacatactctatttaatcaaatgaactaaaccccttcacataaatcaaaacatttgaaggatctgttttatcatttgtcctaaccaatgtaaattatcagctaatatctaaatgatcaatgttaaaagataaatgaagataatttattaaaaattaaaatcatcatgtgactattaattaatttttaatcttaattatttgaggttatatgactcaaatttatatattttatttttaaatgtttacactaaatatgtccccttcaacctttttcatttcataacatatttttttattcattttttttaatttccttatctatccatatcaatatttattttttcaattaacattaaatgtttttatttcaaaattacaaattttaaacatatatttaataatttattttatatttattactaataaaacaaccattctttactttttaatttatattttcacattttatgtatacttatataaaatttaatattttattaattaagttcatgtttaaaatttttcaaaattaaaaatttcaaacatatgtattttttattatatttattattgataattatttcattaataaaacaattattcatttcctttttaagttatctttttccttatttgatgtatatttattaacatatttttttaataccatgttatttgtacatagaattaccgacttggtcagtgactaattttattgaaaacttgattgattagtgtatctttctttgttatcacttttattttttacattacaatatttgaattcaagacatgtttaagaggatgaaggcattgccccagtatcactaggaccaacaattgattgatatttattaacatatatattatgtcgtttcatgagtattgattaaaaatattaaataaaccttgtcaagtattttaaattattttaaaataaacattaaataattcttattggaaagattgacagtcaaagatgttaaaataaaataaatactccctcttaccagtaaactatttcataaggattaaaaatttgattttaatctatataataatgaaagcatctgcaatgaaaattgctttaaaaaaatattattttaatgtgtttaatgtgatattgaatgacttaaaattagagagttatttatacaagtaattattactcatgagttaactttataatagatataagagatataagtaaaatatttgttaattaaacaacttattaatataaatactattagagagaaaattaattgaattacttaagattgaagtaacataaattaagttacttagagaaattcataaagaataaaaaaatagactttttttattatcattgaagttgtattgaaaattaagagaagatatattgttaaatttctcaataaaaactttagaattttaatttcataagagaaggctaataaacattttccatataattaatagtgataaagttgaaagaattaggaggggcacgcacggtgatagaaacggggcgttttagtttgcatgcaaagcatatcatatcatgtgtcgcaggctccttccactacgcaccatttcgtcgcatgatagataatagtaatgaggaagtttgcattacaagaacaagaactaaaccccactcactcactcacacacacacacacacacacacacacacacacacacacacacatatatatatatatatatatataatactcattcaatgcacataataatacaatttcttagaatggcgaatttacccgaatccacctccacaagcggcgcgtcgtctggagctccttctgccaccggcaatgatcgcagcaggatggcgtatatggaaatcctcgttgtcgaactcagcaatccttttctccgagcaaactctctccatgagctctccaatgtagtacttaccttccgtcgtttttccactctcgtgcgtcgttttaatagtccaattaagtactgtataacaccccatttacaacgccccattattccatatactatatcacatgcgtcgtcgtttcaaggctcacacggttaatattttatatattttagatgagagacttatttgaggatcttgctccattattgtggaattcttttggtaccattgcagcaattttacaggtattattacttattccttttgtcactctttatctttcttgtctttttatatttttttatgaatgaatagccccataaatactgactaatattttgtttcttgaataccttgtttgtttcaaatcccagttttatgtatagtcttgaaaatttggttgtactttgacgcattttggtttgttttagaaacaatttcaaaccttaatagattttagatgatatattcattgttgagtagtgtaatttttttattataaaaagagagaattaaacatgctcctaatttatttatttttagttttttttttctcaatgaagaggtgcttctttgacctttgttgcccaccgctcactaggatttttttttcttccaggaaatagtttcagcatacccttttatttcacctccaggcctgactcaagcacactcaaatcgagtgtgcaaagctcttgttcttcttcaggtccactcacatatactttgtctggtctttctctccttttcttcaatgcgttcttactaacacatatcttttgctctcatggatatcttacagtgtgtggcatctcaccccgatataaggatggaattcctccatggtaatgatattttttcttattcacctgaaggaccgtgaacttctgtttggtaaataatattatttatgataaatagtatctttgaaaatttggtcttcaactgagtcaaacggcattgcatgattcatgtatttttgtggttgatgttgttcccaaactttgcttttgtacggtatatgttcaatacatataaaatgattgttgatatcttatcatctcctagatatattttccctttttttctcactaataaattttcttttgcatttatttaaaattgttataagatattgtaaaagcaaccaattgcaaacaatttaaaagtaagaaataatttgttaaactataaaatttcataaaagatgattaaaattgttataagttttcttttgcatttatttctctcctatttcttttaccattcttttcttttatcttattttcttttttttttttattttattttctctttttcttctccttctccttttttttttttttttaactttcttgtatttatcattaagttcatttattatcaacctccaattaatttggattaaatgtaatggtcaaaagaccatacatacataatctaaaatgttttctgcctataaaacagaatcatgcagtcaatttttatatgcaacttgctctctctctatcttatcataagacttctactttatcttacttgaaaatgaagtttctctctctttcaatttataggtcataccacttgttcttctttcttagcattcagtcatacttatattttttttactgccaatatactttcataagcatccatggacagaaacttttgggcaattgaaaggcatattagttgttcttttgttaatataaaattaaggagattgctttgacattaccatatccgtttcagcagggtttttgctcattgaaactaacactttaaggaaaaagatatgactctttcactctttacacttacctttttctcatctgcagctcgtatacctctatatatgtatcccttgcttaatacaaccagtatggccaatccatttgagaatatgaggcttaccagtcttggagtcattggtgccttagtgaaggtactacgtccttgctgattctgttattgaatacactagactatgagaagaataattttttatacaacatttatgctgaacagagaataatttcaattagtaaattattgtcacaataaaccttgccataaaaaactaaatactacaataacctcaactaatatgtcatttaaaaaacagtaataactgattattgattattataaatctgtggcacacaggtaaatgtgtaaatattttagttgccacaaataattagtcttgttataatcttataatgttcatgtagattttcaactatttgttaagtttcaaattcattcctgtaataattttctatgatgtaacaggtacatacaactcaagttgttcggattagttcatcgctagtatcagggaacaaaattttccgaactattttatgcccttcaagatattgttgattttttttcctagtgggatgaagctattggtttttttttttggttgcttgtcacatgtacatttatacttgaattttgtcatgtgtttaatttcctttctgttgatatttcaccagtttcataatacagcagctataagtttccttctttcaacagtttcttccgctttgcctgcatagtatgcaaataggcggtgaattgtcaaaaactgtaagtttactgatcttgttttaaaccaatttggttcgataaaatattttatttggatgaattaaacttgatttttatttgcttcatttttctgagttacattttttgggtatgtatgatgaacatgtatgcatgtgaagcatgttccaatacaatgctacataggaggtgtaaggcaattagcataccatttatctgatcaatgagattacaactgaggaaagtggtcttggcataagataaatggatactatgtgaacttggggagggatatcatttaagaactctcttttttttcatcttttgaaatgttggtcttaatataagtttttttagtggttatcacaggactgttgaaactcttcttgacatatttggttgtagaagagtgctagcaatactccttttaacattctattattggttgaaatttgttgaaaatcacaaactttggtaagttccacttttaaattaggacagagactcatcaaacgagaagtaagaaccactattataattttcaataaatttaaactaataaaaaataaaaagaattttaagagtgttgcaaacactcctcttggttgtatcaaaatgcaactcaacaccagtatttgtagttacatgggttgaaataccccgtccttgatacttgagatctaaatctttaaataacacgtctgtttaactcttgcgttgtacttcttgtggtgcattgtaaatgctaagccatgtgtttgtttttgccactatctcgtgatcatctttttatgcctatcaaaataattgtaatgggaaaatttgtgtgtaatctaatggaagttccaccaactgcatgttggaacctttatagttgaacaaattctgtcggttgaaaatggtatgaaacatatttgtacttcagcagggcgcctttttcaagtatatatagttttcggaacgatggtggtaactcttgttcagcaaccttcgtgtagtcttttgaaggtcattattcgttgttatcttcgtctgtcagaaaatcagaggtttgttaagtagatagtaactccagttttataagggcaaaaaaatttaaataatgcgatttaattaaaaaattacgaaaatatggcgttttgaaatgtaattgcaaatctactgcgttcaaacacgtctggacaaaacgtgttaaaacacgtcgagctgagacgtgttaaaacacgtcctgggaggacgtaaatgaggctggaacacgtcctggctgggcgtgactttgccctagacacgtcctgcatggatatcgtcgtgtcggggtccaccaatgagtctacctgtgcgacgtatcttcagctctctctgtgtgtcctcattccacactgcctgtgaaatgtgagtgcgttgcctccgccttcgaagtacatcccatctatatggaccgggaagaacatgcgttgtgggatcgataggctcatgctcccggtcagagccagaacgaggtgactcagatgacgatgactcagccataataatatgctacacattttataattatattataatataaaccctaattttaaatacaaattatttaattcactaactatcaaattatttttacaaatttattatgtatctaggtcactatctgataatctacttcgtaatctaggtcactctctaataatctaactcaccaacgataaaaaggtctatttttgttctggtcacaagtgtttcaatatgctatataccttattgtcatcacaattagtcatctcatcaatattaactatgtatgtcaacaattttcattaaaaaaaaaatataaaatacaagctcatttgtacaataactttaaattatgattttgcaaagaaaatgaaatatgactctacatgcttttttatttagagtttaacgttgatgattattaatgtaaaaaattacaatgttattataaacaattattttaaaaaaattaatataacttttaaaatagttattataaaaagccaataagattatcctagaggatggtttttgattggataataatataagatgatttacattgttagttcacaactttttttcttttattttatagaattaaatatttaaattttaaattaactattttaaataatatatggtatttaatgcatatttaatttcttattaggaagttatgaattaaaatttgaatacaattttattctttatataatcatagaattggtggagtgatataaatacttattatgttcacatataaaaaattcatttattttaacaaaacaattgtatttaatttttttctaaaattttattgaattaatactaattaattaattctataatttgttttcaaattgctacaattttgtaatcttttttaaattgtaattcattaatttttttcccaactaacaattaacctaggtcacccactaaataactattttaaaaatctacatcactaactaaaccctaacaactaacaagtaacctaggtcacccacttgtatcctaaaccatagaaaatatttacctaaaccatagacctaggtcctaatctaggtcactatctaatactctaagtcactaaataacaatttaagtaacaaactaataacaaacaattaacctagctcacaaactaactaactatttaacaatctaagtcactaattaaaccttaacaactaactatttaacaatctaagtcactacttaaaccctaacaactaactaacctagtaagcatttaagtcactaactaataatcaagtaactcaaaagaaataaaaatattttactactactaacttgatttatatagagcttcttgcttccttgcttgcaccctatttgcaccttccttgcactttccttgcttccttgcttcaaatgagagaaaaaaatttgagagaaagagagtttagagaggcagtggcaagtgtggctggggtgtgggtgtataaaaagggggagctgaaacacgtccctggggagcgcgaatggggactgatcacgtcgctgcagggcgtaaatggagctgatacacgtccctctaggacgtgaatggagctggaacacgtctccccacgacgtgatgcagtgcaagttgcatccctgcaggacgtgattgaacgctgaatacgtctgccattgacgtaactcaacacgtctcaggtgcccgtgaatgctttctgatcacgtccacccatgacgtgattcaacacgttcagctcaagcgcgaatggaagcagtagatgcgtaatttgatttcaaaatgcattattttcgtaatttcttattaaaatagcattatttaaatttttttgccattttataagtgcttctgcagttctgcccatgtcctttacgttcttcccaagtttctaataaaactttggtcatttcaaaacagagtttgtcatgcattaagaacctgtcttccagccgtgttaagagatgctacattcagtagttgccttcgtgtaagtgatattattagtataaaaatttgatttaatcaataagattgaagtgagttgattacgtgaattgaagattaacaatagggcattatttatggttttaggatgtttacatttttttatggttttggttttatttattcaggaacacccaacagctaggagatggctacagcagttgcttcataatattagagtcaatccgtttcctgcacaacaaggtggaggaggattcgatcatatgacggggtcgtgagaacaagactttctggggtttctacatatataaaataggattttcagttgggcatgtatagagagaatgaagaattgaatgggaagggaactatctttccgtttgatgttaagagtgaagtatacatgagctgatgagcatagtcacctcttaattgaatgcaaatattaaaatcataatgagccatatatttcaaaaataaaaaacttctcttcatctatatgggtaaaggagattgttagagattaaatataatatgagagtaaaataattattcatttttttcttttaaataatagaatgtaaatttagttccatgctattataatatatgcaaccaatagactggaaattttattccattatattccactttatctcattctatttctttttcatcaatccaaacaagtccaaaactcaccaagataagagtaaggaaccaattcgataattcagttgaccaatagaagaatctcctcaatcaaaacccattgatacctcgttgatcaaatcagacctaaacacacaatataaaacatccaagaacatacacaccgccaatcatgaactaaatgtgtcagggagagagaaaaaaagaaagaaaaaaaaaaggaactcatctcatggtggtggtcagcgacaaagatggcaaatttgcaactaatgcccaaagcattggatattgacgtggaagataagggggaagcgttaatcgaactggtttgaggaactcctcttttttctcaaaaggatcttgcaaagcttgaaactgccaagattggcttgcgtaaactttactgctgatgaaaattggtttgtgaaaataattgtgattgtgaggggtgttttggaggcaatagtgacaccggatgctttggagaaacagcctcaaccagtgactatgttgtatgagatgtgccaaaagaaggcttattctaaaaatcatttataatagttgtcattcattttcatcataatgaattgattcagcattgcaaatgaaattaaaaaccttgcctgataatcacttataatacttatcattcgttatcctatttttgatacaatattaaaaaatattatatactatatttgaatgcaatcttaaaaaatattttatcttattatgtaatgtaattttaaagatttctattatattatgtaatgcagtttcaaaaatattttatcctattttttaatgtaatattaaaaaatattatatcctattatattatgtaatatattcttttttattattaaattacttttttaatttttaatatatataataaaatttatattaataaaatttgggggtggcccatcctaacccccctatctcctcccctttccgcaaaagtcactctcaccctgtctcacttcattccaagtccggtccttcagattttcttttataaccaagtcaaattccttttagaagtgcgtgtttggacgacatcttgctctcattgagtaggtgggtcacgacatcttgctctcattgagtaggtgggtcacgactttttttttttatacaataataatatgattgaattttttaattgaaaaaatgaagtagacattcacttgtacttgtgggatagtaatttattttccttttaggttgtttcattattatatcgaacaaagaagacgagttaagaatatatatatatatatatatatatatatataaagaccacttaatatatgtccttattaatatctttttatttatattaaaattacttcttaatttatttatgttttttatctgttatttttattaattttttcactcttttataagaaatgatacttttaattagtcttccaaatattttataaataataaatttatataatatttaaaaatagaaaaaatatttaataaaaaaaactagaaaatcagtatgaagatgttacatgaaattataattaatttaaaaaaatgtgttttgctatctccttgtttaagaaattatatcatttcttcgtaataagtttttgtgcgtgtatcatattaaagttcgaacctagttacgactatgaccttatgtgtattatccaaatctgtcaccactagtctttgtaacaagtgtatcacatgatcttttgaaagaaattatttctttcttttgataaacttacaataagaaaatatataatttaaaaatttagaacaaattcatatgtttagaatagatctaaaatgaaatagatgtatttggaaattagttgttttaaaagaattctccttaaatatacaatacacatcacattctatttttattttaaaattgaatcaattttgtaagtttaaaaaatacagggatttctcaatgggtaatgttatttcaatacttaaccaaagaacaactacattaccaatagaaaagatagtcgtcattactatagtggtgactgaaggacataatgaattttggaatttattaacattatctaaaaaggatatcgttaataatcttataggtatggaaactattaaaagaacaccttattaagcactctacaaagcatttgaagtatgagaaagaaatattattcagataatatttctaaggagttgcaaatggatcaatgagttccccaatcatggatggttctaaaacggctaagttaatgacaatactatctatagttattaaatataaaatattgttggaccatgcatgttctccataatgattatgactcatttccttagtcaatttagctcttaatataagatcattcaaaatatactttttattcgtgaaaattgataagtataaaaaaaatttacgataactcaaagactctatttaatcaaatgaactaaacccctacacataaatcaataaaacatttgaaagatttgttttatcatttgtcctaacaaatgtaaatcatcagctaatatctaaatgatcattgttaaaagataaataaagataatttattaaaaattaaaatcatcatgtgactattaattaatttttaatcttaattatttaacgttatatgactcaaatttatatattttattcttaaatgtttacactaaatatttccccttcaacctttttcatttcataacatattttttatatcattttttttattcatttttttttaatttccttatctatccgtatcaatatttattttttcaattaacattaaatatttttatttcaaaattacaaattttaaacatatatttaataatttattttatatttatcattaataaaacaacaattctttactttttaatttacattttcacattttatgtatacttatataaaaattaatatttattaattaaactcatgtttaaattcatcaaaattaaaaatttcaaacacatgtattttttattttttattatatttattattgataattatttcattaataaaacaattatccatttcttttttaaaaatttgattttaatctatataataatgagagcatctataatgagagttacttaaaaaaattaaatattattttagtgtttctaatgtgatattgaattaatttaaattagagagttatttatataagtaattatcattcacgagttacttaactttatagtaaatataggacatataagtaaaatatttgtgagttagacaacttattaatataaaaactattagagagaaaattaattgaattacataagattgaagtaatataaattaagttacttacaaaaattcataaagaataaaaaatagaaatttttaatcattgaaattgtattgaaaactagtatttgacctgcgcttacgcacgggttaattatatattattatgcacattatcgcgttaaacagtttaagattgatcgaaaaggtaaagaaaaatataaaagcaatttatatagatagtattatccatacaacttatggacataattaaatagtgcaagataaagcagataagtttaagagacagtggctacaaactgagacaacttctaactgaaccatgtagtttctattaacatgcatatttaaaagctgacaggtaagagctgttttttgcaatcaatacatccaccagtgtactatgttgctacttgggtatgaaatctccataataaactcgaagtcagcttttaaattgttggctcgtgcaaaagctttccaaccagctcctattttagcactctttctctggtggttaaacataatcttgcatgttattcttccttcaaaacagaccgttgtgaaacctgtatccttaaggtagtaatacgcacgggttaattatacatttaaatgcatattatcgcattatgtaaaattggagatgaaaaaagaaaatataataagattcattaatgtgaaatataatatgcaaacattgtaacataagtttataatgttaattacaaaaaatatgaacatcaaatagaggtagttaaggaacacaaaaaacaaaattagaatttttgatttggttgactatatattttaaatgcgtgtaatgtaaatattcattagtaaaaatcatatataataagattcgataatattaaatataatgtactgaaatgttgatagatatagttaacaaaaataaaaaataaagctagagttcaactttggttgagttgaattagaaaagttacaatgaaccaataatccaatgcacaatgttgtttgttagatatgaaaactccatgataaattattttaaattaactttaattgtccaataacaaataattaaactattattttttaataatatattaattaaatattattatgtggttattgtaacaaataaattaaatacaaagagtttaaaaatttcaaatattgattaaatttaaataataacactataaatattttttttaaaatgtcaccacttaaatttactgttatttatccattatttatatgatgaaaatttaaaaataaataatatatttaataaaaataaatattgttgattgtttgatatgtaattatgaaataatgatgaaatctattgattggttaaaaaatatgaaataacagaatgacatattcaaaatgaaagttatttacaaaataaaaaaaaatcaattatattaattataaaacctgtaattattatgttagaaaagaaattgtccttaatgtcagtcttgatgtaaaaaaccatagtttcatgcatttaattcactttacaatcaatcaccttatccagaaagaactgaaagtagacaattgaaagaagacttccaagtgcaggaatgctagtggtcaggatcaaatttatggcattaacatacctgcaagaaaatagtacagttaaactaatgaactttgtctggaatgataatcatttgctaaattttattaaggaattcaactttgattgatcacaaacacactcaagaataccccaagggacatgtgtcattgcagccatttccatgtcaaatttagtttccaggccatggactaaggtcactaatgatgttgttataatgaccgagaattcatcctgtataattgcatagttctgttagaatgggagctgtatcaataagaaaaaaaaatcatttattgagaaggcattgatacctgcacttcagacatatccaccccatctgaatattgagggtcaattattttagaaacattttcaaaaagttgaccattttttgtcccaagaatgacttcctttgtggaaactgtatttaaaaagtttattcaaaacatcaagcagaaaagaaaatgtgaaagtcttatagctcagtccaattgaagaaaactgtacctaatcaaactgacccagaactttaatcgcgatcgaggctgagaaaatgagacgaaatgtggcgctgacacgtagcatccgaagctaagatttattgtgagcctgtcagctggattccgaagctgagaatgcaccaaaagttgacacgtacccagcaaaatgttcttttattactgtaatgtaaaaccaaaagaataaaccaccacaactggagcataccttcatcatcaccaaataaactgtgtttaagcttctcctcagcagttcataatcatgacagcattgcgcattgttgaaattttaaaaaataaaagacagatttatatgtaattataccattcaaacaatatgtggcacacgcatatgattccttcaaactcttgggagtacaaccacattacgtattaatgctaattgctaaactccaacagattactatataaaataaggaaagtcacacctagtaataaaagtttctgaatatgctttcagcctttgtttctaactggattcttctttcaatttctgcatcctgcaaatgcacgactcaagtttatgaatttttttttgattaaattgaataacacacctgtttcaaagaaaagcgtgaataagaatagagaaaccagacatgatttttcattcatgccaagcataccattgttccaatcctttaaatgcatttcgtcctaaagtaatcggtatcccaccaaacaattgcacaacttgcacatgagtgtatcaaaataatttgtattctctgatggcccaaaagagcaatgttttatttcttgatactgtataataaaatgtatgtgtcagtgaatgaaatatttttttaaaaattaagaaatggtgcgaagtacttcaaattagtccaaactcaacgaataatttgtttcattaaagccactgggaaggaagcgagtagattacttaccttttggtatacaacaaaaaaattgttaaattcatcaaatatgcgatctttgatttcactgctctgagtatcagcaaatattgaaactgcttgctttggagggttaaacacactctctgccactatactttgtattgcagaagcctgtaataaaataaggccctatcatgaacatcatgcaatcaacaaaaagctcatttaacataccacaaagcaaatattcaaacaattcatttagcccaacagggaaaccactgaaaaccaatcaaagaaaacctattaacatttctaatttgagatgcatcaattttttttgcaatgaacacgttcattacacaaagttccactcaacacagacataaggaccaatcctgacacaaaggcctgattacagcaccagctcaccagctttatgaatgcaagaaagaaaaactaaaagccattatttttctattttgagctaccttgccaggtgaaggttcgtgtccattccagaaaacataagtctgaatcacatccaaacctccgtccttggccttttgaataagatctgcccacatctgagaaacaaagaaaccccacaagttactaatgcaaaaaggaagaaacttttaaggcacccaatatatctatatatatataacaacaaagctaccgcatcatcaattcaaatctcaaaaaagagccacacaatatacctagcttacttccaaattccaacaaacattaataaacctggcagaaaggaaaaaaaatataaaatactactacgcacactgaatgaaatcgagtaatagcatctttagtgaaaaggggacacaacacacatacaaagaatataaaaaaaatggaacaaaaaatcacagcaaagcagaaaccacaattaaccacaactactaatgtaaaagcaaattacagattcctattccatgacaaaaaaaattagtgaaaatctttgtcaatagatccaaccaataagcatgggaaggaaataattgatgctgatattctgcgatgggcaaacagcaaagtcatcagtttgggaagtcaaagccgaatggatagtttcaaggtgttttgaatgtatataaaaaaaaatcatacaagtatctgctgcaaaggactgactatcatgttctttggtttacttttccctgatcttgttcattattaattattatttcttagaaatactaatattttgtttgtaatattagtaagatttttattagttttatgcctattccttgctgaatacagagctactgtacttatgtatgaaaaaaacaatcattaggggtcatactccctactcatctttacaaaataagtcttaaacatatatgcatgtctaacttggaatccacccagtagtcaggggaacaaaaaatgtgtcattttctcatcactcaattgaaagaagaaaaaaaaggtggaaagtttgagagagggaataccattcactggtatccagctggagccatagccgacggaagtaaagaccctattttttccaccttactctaccaacacaacattattgttccctcttcttaattctaaaaaaagaaaaaggaaaaggaaaaggaaaaggcagaaagcaaaaggtagaaatgaaccttgtggtctcttcttcagcagccatggctctcctcgttttccacagtagcacctggtggtagtgctctcccttgccaccaccctcaattccatctgaaaaaaaaaaccccacataacaaaagcgaagtgaaacgcaaagaaagagaagaaagagaacacactgttgtgtgagatgaaaatttatgtccggcaaggttaatcttctccttcatgaaaaccttagtgtcaaaatcgagcagcgcaacgcagggcccttgaacaccgacggtgcatcggtgaagctttagggttttccaaacgaactgttgttttaggtgagtgaaaatggatgatagagacaagagagtaactgagaaacgaaccgtgtgaaggaagaatagtaggtgaggattaaccagaaatgtcagcatttgagacgtgggagagagaaattgtctgattgatgaaggaaaaagagttggaggatgaagaagaaatttgaaatcttggagcgcggttcggatttgctgaaggttgctcgttgaactaaacaaagctgagggtgcgcatgtccctacagaggtttggaattggctgagaaaatgagacgaaatgtggcgctgacatgtggcatccgaagctaagatttattgtgaacctgccagctggattccgaagctgagaatgcaccaaaagttgacacgtactcagaaaaatgttcttttattactgtatagattatgaaaggatattgtactgcacaaaattagtaaaattattatgcattgtacacgtgtccattaccatattataataaatatacacgtgtccatcaccttgttatagtaaatgtacatgtgtccacggaactggacgttaacactcaacaatgtgtctctcttatcaacaacaacttatttgttgctataaccactctacacacttggaccatcagagtttggaaccaagttgaattcgtctattcaaatttccaggttttggtaagaataaatatattgttaaatttttcaataaaaactttagacttttaatttcataagagaaggctaataaacattttccatataattaataatgataaagttgaaagaattaggaaggacacgcacggtgatagaaacgagcgttttagtttgcatgcaaagcatatcatatcatgtgtcgcaggctccttccactacgcaccatttcgttgcatgatagataatagtaattaggaagttggcattacaagaacaagaacaagaactaaaccccactcactcacacacacacacacacacacacacacatatatatatatatatatataacactcaatgcacataataatacaatttcttagagagtgaatgacgaatttacccgaatccgcctccacaagcgacgcgtcgtctggagctccttctgccaccggcgaggatcgcagcaggatggcgaatgtggaaaacctcgttgtcgaactcagcaatccttctctccgagcaaactctctccatgagctctccaaggtagtacttaccttccgtcgtttttccgctctcattcgtcgttttaatagtccaattaagtactgtataacaccccatttacaacgccccattattccatatgctatatcacatgcgtcgtcgtttcaaggctcacacggttaatattttatatattttagatgcgagacttatttgaggatcttgctccattattgtcgaaatcttttggtaccattgcagcacttttactggtattattacatattccttttgtcactcctagctttcttttgctttttttattctttcttgtcttttatatttttttattaatgaatagccccataaataatattttgtttcttgaataccttgtttgtttcaaatcctagagttttatgtatagtcttgaaaatttggttgtactttgatgcatttttgtttgtttcaaaaacaattttcaaaacttaatagattttagatgatatattcattgttgagtaatgtaattttttattataaaaagagagaattaaacatgctcctaatttgtttatttttagttttttttttctcaatgaagaggtgcttctttgacctttgttgcccaccactcactaggatttgtttcttctttctaggaaatagtttcagtatactctgttatttcagctccaaacatgactcaagcacaatcaactcgagtgtgcaaagctcttgctcttcttcaggtgagaattgatatgtccttgtcctatcaagttttatatcgtgtgttcaacatatttcaatttgccccaaatattattttttaactctaaaaatcaattggtttgaaaatgagtccagtccatggttctaaattgcagtagccatcgccgggcatgtaaaatagaatagaagattgaaatctaaatctttttattttttatttttttgggtaaataatcattttcgttcttaaatatgtagagtgctgataaattcattcccgtaaaatgaaaattcaaatttttgttcctgaaagtgaacaaaatgtgacaaatctatccattttattctcccttttctaattattgtaagcataaaattataataaacacttaaaaattaggaaaacaagtataagttaaaataaacataataataaatgtaatattgattgataagcataatttgtatgttgatctaaaatttatattctaacaacattagataatgacaaaataaagttgagtttcatttttttgtaaggattaatttaatgattgtattttaatttgtttgagtctcatattttaggtaaggtattatctcatatttttgctttgaaatttctaatgtgacagtaatttatccaaaatataagaccaaacaaaaatgcatagtaattaatttaattcttaccaaaaagatgagacctaacttgattttgtcattatttaatgttattataatagatattttagagtaacaaataaattatgtttattatacttattattatgtctgttttaacttatgcttattttcctaatttttaaatgtttattgtaatgttatgtttgctgattaaaaaagagagaatatgaagattaaattatattttgggtaaagagctgataaatttgtccctgaatatgtagtgcgttaacaatttggtccatgaatattaacgataatatatgaaaattaatggagagataaatttgttatatttttttcactttcataaacaaaaatttgaattttcatttttcaggaatggatttgtgatttttttttttttaaaaaaaaaaaagtggaatagaacggtgctaaggttccgttgctgctccaatatggttctgttgtggctaggtggcagcagatgcgttgcggaattttgtgtgattgaaattcacactgcaggttgcggacaacactgcaacaacaatattccgggtgcaatttagaaccatggtccagtcacatatactttgtcggatctttttctccttttcttcaatgcattcttactaacacatatcttttgcatggatttttttacagtgtgtggcatctcaccttgatacaaggatgatattcctccatggtaatgatattttttcttattcatctgaagaccgtgaacttctgtttgctaaataatattatttatgataaatagtatctttgaaaataattgttgatatcttatcatctcctaattatattttcaataaatataaaatgattgttgatatcttatcatctcctaactatattttccttttttttatctcactaataatttttcttttgcatttatttaaaattgttataaaatattgtaagagcaaccaattgctaacaattaaaaagtaagaaataatttgttaaactataaaatttcatgaaagatggttaaaatttttataaattttcttttgcattcatttctctcattcttctttcaccctttttctttctcttttccttcctttttttttcaattttttcgtatttatcattgaatttatctaccatcgactccaattaacttgaattaaaggtgttgttgatgttgatgattaaaagaccatacataatctaaaaagttttctgcatataaaacagaatcatgcagacaaattttatatgcaacttgctctctctctatcttatcataggacttctactttatcttactagaaaatgaagtttctccctttcaatttataggtcataccacttgttcttctttcttagcattcagtcatacttatattttttttttactgtcaatatactttcataagcatccatggaaagaaacttttgggcaattgaaaggcatattagttgttcttttgttaatataaaattaaggagattgctttgacattaccatatccgtttcagcatggtttttgctcattgaaactaacacttaaaggaaaaagatattactctgttcactctttacacttaccttcttgtcatctgcagctcatatacctctatatctgtatcccttccttaatacaaccagtgaggccaagccatttgagtatttgaggcttaccggtcttggagtcatcggtaccttagtgaaggtgctacatccttgctgattctgttattgaatacactagactatgagaagaataattttttatacatcatttatgctgaacagagaataatttcaattagtaaattattgtcacaataaaccttgccataaaatactaaatactggaataacctcaactaatatgtcatttaaaaaacagtaataactgattattgattattataaatctatggcacacaggtagatgtgtaaatattttagttgccacaaataattagtcttgttataatcttataatgttcatgtagattttcaactatttgttaagtttcaaattgattcctgtaataattttctatgatgtaacaggtacatacaaatcaacttgttaggattagttcatcgctagtatcagggaacaaaattttccgaactattttatgcccttcaagatattgttgatttttttttcctagtgggatgaagctattgttttttttttttttttgttgcttgtcacatgtacatttatacttgagttttgtcatgtgtttaatttcctttctgttgatatttcaccaggttgataatacagcagctataagtttccttatttcaacagagattcttccgctgtgcctgcgcagtatggagataggcggtgaattgtcaaaaactgtaagtttactaatcttgttttaaaccaatttggttcgataaaatattttatttggatgaattaaacttgatttttatttgcttcatttttctgagctacttttttttgggtatgtatgatgaacatgtatgcatgtgaagcatgttccaatacaatgctacataggaggtgtaaggcaattagcataccatttatctgatcaatgagattaccactgaggagagtggtcttggcataagataaatggatactatgtgaacttggggagggatgtcatttaagaactctctttttttcatcttttgaactgttggtcttaatataagttttttattttacggattacgagaaagacaaaatcgatattacactgtacatactgaatatattagaaaaatggctggtgtagaaaattaatcccttctttgaattggtgggagtagatggaagaatgggattaagatccattgtttgtattgaaaaataaacaatggaatagactaggaaagtcatggaacccattccatccaatcctatcatttttagccgttttccttcctcaccaaattggggtgtatgcaatgaaacggtaaatatttttctctctcaacgtcatgattataatggttttgctccacgttgtggcttgtcctcaaattcatgacaggtatatttttcagtattttatttcgctgcgttcttattcttccttccattcctctccaacttgccgcgcacacactcaactaccaaatatcatggaaattacgtagatttaatatgaaaatttgataccttggcatgggttgcaagcaatcaaagaataaagatgatgttgagagagtgattgagcaactccagtaaacacaggaaataaagataaatagatgagattatgaagaatggacgtttttttttttttttttcaaaaataaaaaacttctcttcatctatgggtaaaggagattgttagagattaaagataatatgagagtaaaataattattcatttttttcttccaaataatagaatgaaaattttgttccattctattataatatatgcaaccaatagactggaaattttattccattatattccactttatctcattctatttctcttcatcaatccaaacaagtccaaaactcaccaagataagagtgaagaaccaattcgatcattcagttgaccaatagaagaatctcctcaatcaaaacccattgaaacctccttgatcaaatcacaactaaacacacaatataaaacatccaagaacatacacacagccaatcatgaactaaaaatgagaaaatagattgaggttttaggatcttaggtaccaatgagtggtccagattcactctccatctaaacataaatttgagtctttagattttaaataattaaagaataggaagctctacttgatcagaaagcaatacatgggaaaagtcaacccttcacaaattgacagatgtcacaagaaggttgaaaagttgatttcatatggatcggaaaaaattgtcaaagaaaaaaaaaccttgatttcatatgccaagctgctgcgctatggtctaaacaatagccaatcacaacagaagatggaagacaccctaaaattacaacagaattctcttctacatataattagattgctgtaaggcctgaatcatcaaggaagcagcagagttttctgcatccttcacccgagatttttcatcccctgacatttgaagaataccatcagcagttggaatctgaactgcgcagacaaatttcttttcatgagagggacctgaatccttttcaatgctgtgagccattgaagagatgcaacaagttagtcaacaaggaatgttaaaagtttcactcacgcatgcaactgaactgaaagaaaatcatgttaaagaacagtacatgtactctggtataggccattttttaaccgcacaaatctcacgaagtttatttttgggtgcttcaacaaccaaggtaccattttcatcagcagtaaagttgagattcatgttagtggcagacttcttaacggtggaaggcaccaaatgtgcgagtttatgcaaggcaatcttggcagcttcaagctttgcatgatccttttgagaagaggaagcagaggcaacaaactctccaccaacaaacaccttagcaacacttacatctccttcccttgactgttttatatcaacctgcttccccttcttttggcacatctcatacaacatagtcactggttgaggctgtttctccaaagcatccggtgtcactattggctccaaaacacccctcattatctgccacaatcacaattattatcacaaatcaaattttcatcatcttgaatcgtacagcaacttcaatgtaaaagtaaaagcttattctaaaaatcatttataataggtgtcatcataatgaattggttaccacaaataacaatcacaattctttttgtcttagaatatgagtttggacctaatttaatcccaaaaactagctcatagggtgaggattattccccacttatatagtctatcttggtaaaatctctagctaggacttgggttttccccaatacaagccgcccagcatttttgggcttgaatgtgagtttggatccaattcaaccccaaaaattatgagggtcgttctcgacttatatagtctatcttggcactatctctaacccacgtgtgaattggatttttcccaatattttgtctagaccacaagtatcttctatcggaatgcaatcaaaatttaaaaccttatcaaataatcaaataataatttacattcattcatcgagagcacaagcacgcaacttaaaaccttatctgatttgttataaacgtgataacgaggagatataagaatagcttggcggtgaaagaaaaagggagggcggaaggaaagaaaaactaacatacaactaacataaaggtgatgatgaattgataaaaggtacggtaccatccatagtttctgaaggtcgaaattgacgtctacgtaaaccgcggcggcgacggactcgacgacgtcggcgaggaccttgggggccttgacggaaccgccgtgagagacggggtgattctcgagcttgacggcgtcgacgaagcgctcgacctggtcgacgaggggaggggcgctgtggcggacgtagcggtggaggccggtgcggacggcgacgcgggcgagcttctcggtgctgatgttggcggcgcggaggagggagagttggccggggtcgagatgagggtaagcgagaaacaagtggttgctgatggcgagactgagaacggggtctccgacgaactcaagacgctcgtaggagacagcgtccacgaaggaggagtgagtcagggcttcttctagaatcttcctgtttcgaaatccgtaccttaggatattctctacttcctccagcaaacacacctccatctccgcaccacaaccaaacaaaaacaacacaacactcactctcaccacactctctcacttcaactcaccaacaaggttttttataagtccttccagattttttttttatttttataattttaaaagtgtgacgaaagataaaaatatgaatttaatttttgaatatataaaaaaatatgataaattagtctcttaaatttataagattatttttttattaaattttaatatttaagaattaattttattataaattatatttttaaattaatttgatattaaattataatatttaaaaattgatttagtgtcacattatttataaaattaattttttatattttttatatttatgaattttaaatttaaatttttatcttttaaaaatcaatgtcatacatttttataggcgaattttaatatttatcatttttttaattacctgaatatattttgattttttttctaaaatcagacacgacataattgcagcagtaaaaattactataaaaagacgaaatatttttttataatcaattgatattttataaaattacttcataaaactagcttaaacacaaaaaaaattaaatgtatattaatatatatatatatatatatattgactttgaatataataatttataaattattgaataaagtatatttgacaaacaatattgttataacatttgatattatcagtataatattaatataaatatataaataaatagatttttcatatattttatgacataaatttgatatttaattaatattctataaaaatatgtttttcaaaaaaagtcaaatggataataatacaatattcagaaataggtatatatatatatatatattataaataaatattaacggtcatatagtaaaataattttatgaaatttcaaaaagtattgatataaattactttattataaaaataaaatttaaaaacattcaaaaaatataatatacccgtacatacacaataacaaatctagtcatgtcaatgcgtgtttgggtaggtacggtcaccacatcttacttatttttccattgtcacaactcacaagcaaagcaattttggattttttcttcatttttaattattcaccataatttttgggactaaaatcaattttatttggaatccaaacatgcacacaatggctcttgagtataaaggcggataatctttatctatttaatgtagaaacaatgtacatttaaggaactttacaatgtagtttttattcttaaaacgcgagtgacattatgacttttattttgtggtccactgctttaattacatgtgaattcccagcttttattttgtggtcgatctattgctttatttacatgtgcttaatcatttgacatgtgttccacctctgcaaagacctgccaagtcggagttaggacttaatcattggaaacttatctcaacataatttggacgacttacaataaacgtttataaaaatggtggcaaaattttcgtcttttaaagaaaaaaaattgtttagttataaaaaacatgaatacaattccttttaaaagaaatatctgtggcttagtagggcaataacatataataaaaaataaatgaatatatgccgctggaaatctaaataccttataggcaattatttatataaaaataaatatgcttaattaatcaaataaaccaatagttcaatggctacataaaataagggatgtgcctctatgactctaagatacctgatagacaattataatcaagttccaaaataagatatcttaacgagagcaaatcaagtagaggtaaactaagatattaatgtaaatttaaggtttcaaatatttagaacctaaataaagaagttgaagttgttcaaaatattacatggcttctaaggccatgagagaacaagtatatatacatgaatcatacttaaaacaactaaacctcattcgacagggcatcttatctttctctatggttgcctggttcaatgcccaaaaattcaggtatgaggtggattttttttccttttcttaaaattaattaatataaagaaactattctatgtatatgtcatattttaagcaattgattgtgaaacatacataggaatgttcaagaactttcttgatcctccaattcactttagtaaccacaatcatcctcagttaagtccatatgttaatcattaattaatttgatcatgttccccctcctctaaactttggtcattaacttagctttagatatgtgatatttctctaatggtatttgttttctcatttgtaggtcttaaattgttctgataatattaattattttattttcactttgactcaaataagatgttcggtaaactcaaggattataaaaattagaagagacattcaaaggcctccaaccatacacaaatccatgtttaaatagtaacacaaaaaaagaagattaaaacgaaatttaagttcatggtatcttgataaagtttaggaatcaactaggctaaaattaaaatttaatatgtctatttgtagaagagataaaatttaaggtgcctaaatactctttttcctaaaaatatagtaattgaaagagtacattagtatttttttaatgttagtatttttttaatgtaataagggttagaattttaaaattctgactgcacagttaaatccaaaatattgaaaaaattaggaatagttttttaatttattttttaaaacaaatgtattaataatgattttttattctcaattgttaatatcattattttaattaatttaaatattagaatttatatgttgtaaaaaaattaaaatttctagcctaggattatgaattttttaataaactttcaatatagtagtatgttataagtggatggttaatatatatgtagttcggatggtctcccactcccgcatttcctgcacaatttttttccatccaaaatctcaaccgaacatcaagtcatctctcatctctggttagtgtagattcttccattcaatggttcatatgttgttaaatcgaaaaacagaagttttgttcattgtgcagcaggctacaaatgatctgcatgctaaaaatatacacaagatcattcaatggattttgcttgcacacacaagacttgtctcttttgcttgcacacaagtcgaatcttttgcagttacttaatttagactcatgcttgcaaacacattgagtaagaatggatatgagttcttagattgtgctcggtctccattgttatatatattttagataatgcatgatgaacctcaattatcaattctattcttgtactccacaattcagaaaagaaaaagacaaatctttgatgtgagaattgtcttttttcatttatttcaatttagttttttgtccatatatctagttctgttattttattcagtttagcttgcagttttatatacgggctcctaacaccctttttgcaccaaaaagctgtgatcgtacgtgattatcttatacatttgattttctattatttcttcaaatactgccaacttgatgtgagtgtggacctcagggatgcgaatggaaggtcgaaatctaaatcttagttgtaagtttttaccttcatttattgtttagactttagaagataaggttaatctttactttggaatttagttttgtcatatctgccaatgtttttgagatgggaccatgaatgaatgaaattaatatgaaattttggttttctttgaagatgcaagggagttgaagaatattggtgaaaataaaccatcaaatgccacacatcaaacggaaatggtatttctagctcgaaggaacgaaagaatatttgcattttaattgatgaggatgacttcatcattatctataattaatctttaaaaaacgtactctatgcaatctcactattgaaattgttttattctattaccaaaaaaaatggtaaacaaatctaaacatttaaatcgggcaaaaaattacaaataatacaattaaataaaaaattttggcaaatggtgtaatttggaaacaatttagaaaactggtgcaaccaaacacgcccaaatggggcgtatttgaggaggtggtgacacgtggcagcaaaaaaaaaggggcgcgatgttttcgtaaacttcggaaggtcataacttttgactgggacgtccgattgatgcgaaaccggtggccacgcgctcgaaattgagagaaaaagcccttaacaagttccgaagaagactttcccaaaaaaatttcccaaaagaggtctctaagtgcctcaaatttgcgatttaatcttcggagccctaaaaaaaattttgttctctgatattttatctattcaattagtgaattgcaagctattctttatttatctaattacttctcttaatttcgagcattttgacataaaatacgtctcaattggacattgttacgagaaattacaactgttcaaagttatatgcatcgtcaattttacagtataattttggaaaacttttgcatttgggtgaatttgattcatattattaaaagaagacgaatagcacactataagaaaattaaatcacattacaacattttgttatgatgttgtttggttccccacttccacttacaacacaaacaattttataggtcgagcattggttcgacaatgttctttattttcaggagtttgtcaaaattgatgggtatttttcattaggtttaaacatatttttttatctatgatatacatccgaattttgtgtttgatcattgacaaatttttctttcgcatttgctccatggtatttgaaaagttttgttttggatttatgccgtcagttaagtgatgacgtatccattaaatatttgataacgcgatttgtgacggatcaaaaatcactagtatttatttcaaaatcaaatataaattttatgacaattaagaatcaccataataattaaagtaaaaaataaataaatcaaacaacaataatttggtcctcaccattggcgtcggtgccgaaccacttccaccattgcaacaacaataacatggtggcaaccacacaaatctagatctagagcaacttttgtctgttgtagtggaggacaatgacagggttgaagggggatcggtcattatcatggccttgtcgaagatctaccatgttgcaccacacgaatccatatctaccgcaactttcgtctgtcattgtgaaggatgatgaaggagttgaaggatgagtggtcattgttgcgtcgttgtcggagtttcgtcgtgtcgtgccatgaatacagatttggttcttaccccttcattggcatcaagccagcgtgcaacacaccattctatgaatcccaattctgctgcaaacaaggaaccccttcttgaacacccaattgaagtcattgccagaattcatgactgtccaaattgaaagggcaagttgccattcgttcttcaaaacaattccatttgtgagagcatgaatcatttttattccaacacaatgttcagaccgcgtatcccttgatggttcttggtggaggaaggtgagtgcgggaatctaacactggagatttgggacatgcgactatagtggcagaagcccacggtggtgacggagtgagggcccattacggatcgacgtcggtggagacacataggacacaagagtggttgaaggtggcagcgcagaggaggaggtggtcacggaagaggtgggagaaggaaaggacattctttttataacaaattgagatttatttatttttacttcaaaaaatttgagatatgttttaaatgtgattttgaaagaaacactgatgatgatttttgagccgtcacaaatcgtgttgtcaaatatttaatgaacatattatcatttaattgactgtagagatctaaaacaaaactttttaaatatcaaaaaataaatgtaaaggacaaatttattgggcatcaaacataaaatttaaatatatatcaaagatcaaaaatatatttaaacatttttatgtaaaagaaaaagttgtcccataaattatcagttaacaaatatttgaattatcgtctaatacttcatctttagttttgtaacgcacaacctatgttcttttttgttttgttcttttaaggagaatacagactatatctcattcatccaagttatttaattttataattaaaaatagttttaaatgtatttaaacaaatcagaaccgttcaaattcaaattattgcagcatgcagtagttcgtatttggaccataggcaatcaaattccaattccctattattacacaaataaaaattaaataataaataaaatcaaacttatttccatatccctattattaagataaaacataaaatctaaaagataacgtcttacagaaaaaaagagattctcaagcaacattccaaggtaaattgaccccacaggaaataccaaaatataatgtctacgcaatgcctttatttttagagagctagataaagagacaaaattttgtattcttattagttgtcaaagatttctgtaaaataaaaaaaaaaaaaaaaagttgtgaaatattacaacttattatttgctttaaaattaaggggcaaagaaacttacaacctagtaaggttttggttgtcaccaacctcaatgaaatgacatgtgcatctgtgcacactaatataattttactattgtaatttggtttttctttttgtcaaaaaataaagtagagtattaaaatgttgaatttctaaatttaatgtttttctggattactaatagtgtaaaaatatctccacactccgctgagtgttgtatttgtcaacctcttaattaagctgcatattaataccgccgcagtaagatattgaaatttagtgctattctaatactgctgcagtgccagtcattggacaaatttggctgtctattctttgattctttgcacacacaaaaaagaagagataatgtgttaatagatatattcttatttatctaaaaggccgcgtctaaggtaaccaactaactatttcagaagagatggtaaacctagattcctttgattgatatatataagaagttttatgcaacaagatgatacacaacacgtccactgtgtctctaacatctagtatattttaaatttatgtctcactatcatataaataatgatatgggtctttaccaacattgtgttggtcttgagtttaaactttataataaatagataaaatatgatcacgagagaatattttattaacaaaaattaattattaattactaatattgataaatattttatagtacaatataataaaaaaataatagagatctcataacatgtttacctcatgtgaaatagacaggggtctataaacctatctaacaattaatgttcttgatgttaagaaaaatatttgtgctttttcggacgacaattggacacagctagtaaatgcataggatgagtgcattgccattagcatttagcaaccttaaatattaacaaaaatcgtgcaaataaaaatgcttttctcattgtgccaattttttattttcttttgtaaaattcttaaggggacagaaacatgataccccaaattagattaagaccctgtccactgtttagtttgagcaacgggtattaacaactgttggatcatatatttttctgtatatatattgttgataagatggattagacagaatcatgacagatgtataatcaaaataaggcttgatctttgtcaaattgaacactcgtcgtctttctttctttttttatatgcagctggcactatcaaacattacctggcacttattttgggcatgaagtaacactttaagaattctgcactgttttgaaaaaaattcgtccaattacatagaaaaatatccaacatgctgtttttaataagatatcccataagctggtcacgtcatcagttatcacatgacttgagaaaaacggaaaccgactcaaatagagctaaagaattaatattcttatgtattttttatttttactagttgactctaatagatcaattttgtgcttaattaactaaaagctagtctattttgacatgttaaaagtaagtagttgcattcaactcataaatggttagtgagaatacgtttccaagaactctttaaaactagtaatttataattgattttactaaccatgagtaatggttaaactaatataattctttattaaaaattacaaaaataatatattaataatattaaaaaaattctacttttgattccttaagcataatactataaacaattattaataaaactgataattactagttaactacttaattatagtttgtgcaaaccattgctattaagaggctaaagtagacttaaagtttgatgagttaaacagcatcaaagtttgattagttatacaaaaatttggttaggagtgcaagatgcatgaattgatatcacataatctgcatactgcatcttgtactttataaaacacgatagatatgaagcatacatcataatcatatacgcagaccccagtcaattattgatagtcatgcagaaatccagttacaatataattacatatgtcatgtcttaccaacagtgaactccaattacttttccagcctcccccggtcttattctcttcagtcgtctcccattaatttaagcaggaaaaaaaaaacaccacagtttattttcaatagaaaatgctatgttttaatgacatgcaactttttaattgttggagcatgaaaatagatgcagtaaaattcttttaacaggaacttagaagatgataatacagattgaaattagtaaacagacctgacctctaattccaaattagaatctgtacaaacccagtgggttaaaaactaatagaccctcagaaccagtgtttctaaatttaacaccctggaaataatttattaaagagagaaaaagctaatgcgttcctaaaaggcttcctgataaagccaagaattctctctctgcatctttaactggttgtagaagttcccaatgaaggcctcagcttttgcaaacagctcttgcccattaactcccccaacctcatcttcagcttcaatctcctcatccatgacttctccttcactttctccacctcctatgagcaaaagatttggcattgaaggacactttttcacctcagtgacaccaacaatcttctcatcagaagcaggcttttcaacaaccttaggcttcttttcatcatattctgaggcacccacttccaccctttcctcaggttcatacacttctgggggcattacaggtttctgggtgacagaaacatgttgctttttgtcttctaaaggcttagaaaaaactgagagaagaccagcttcagctccaagtgcaatgatgagaacgttaaagatgaagtaaaggtaggttggtctcagagaggaaggtaacaagggtgtgatcccaaggagaagagcaaggacaaagagcactagaagttcagatttgttgaatttgttcatgacttcggtgaatgcgagtgaggaagttaaagtggccaagaggcaagaatgaaataaatgataaaaaaaagatggacagaataaatgaataattaggggtagcaggaagtaatacgtaggaataagtgtatggggttctggacatataaatagaggtgagggagagaaagacaaacagtggaagcagtcacttgcatcagtgtatgagttgttgccagtgtcagtcaacaaaacaacaaaaatatttgtgggggctgaaaattccaacaaaactctcatacattatagtcaataaaaacatcattaggcaatatatatatatatatatatatatatatatatatatatatatatattacagtgcaatattattttagtggagagaacacagttattttttaatccattatttaaaagattaatcctacttgtgaaatgagacatatatattattctttaaatacgaatatagtgaaatttttataccattatgatgcaatatttgttaaatgtggtgtaataccctttaattataattattctttcttctttatttaaacgaataacataatcaagtaataatggatcagtttaattaaatttatttattaaaataagtatttattttaataaaaaaattattttaaatggataacataaacaagtaataatgaataagtttgtttgagcttatttattgaaataagttttattttaataaaatagatatcattctgtttttttgtgtatttatttaaataaaatttaattttctgtttattttaaaaaatcgtatctatttcttaaaaaaacatattttaaaattgttttttaatttaaataaattcactcaatattttgtctttcgttgataaaagtagttcgattctacattgtccaccaataatgatgttaatgaaatatttaatccaattcggatggaaattaaagccagatagatctagtttagtgatttactacttgcaaaccaattgcatgatgttgtgaactgttaaaagcgttatcaatgtcggcacatgaaagttacacaacacaaccacttggagcattttctttttcctatctttactctgtcgtgtagttgattatgtattttatccgaatgaccacattaggaacaaaatattaagttgagctttggcacaaaactgtgacaagatgagattatagcctaggagttaaacttgttacacagtgattagacgagaaacaaaacaaaaacaagggacaaagggaaccatacaagagagaaattaatttggacgttatttggatgttgcgtgataaggcctgtgaaagcatattcgtccaataaggttttcacttttttttgtgggcgttgatatgattttaagggaagaaggtaacctctctttgaactcttcttggtcctgttcttaaaagccgtcggagtggtgggtcccacggttctgatcctatgtgattccaccccagagaactgttaattaaagggtaggattaggacattttgattttggaccccctaataatcatggaaaagcccaactttcctctttttgttatggactgactaaaatttgggccatttttacacgtaagaagcccaaaagttaaatcccgattaaccctatttaaccaaggattttagaaatgaaagggtagaccaaggatattatgaacagtgttgtatgcacattaaccagagtcatttattcttaagccagctgaagtgtctaaagtttattaactaatgagactttttgtgtgtacaataatgataatgaaacttgtaatacaccctataagagagacatggacaagctaaaaaatgagaaaaggattgagcatgttatcaagaaaaaaatggaaagactttcatttgagaaggagaacatataatgtgaaaaagactcgcatactttcatatgaagattgttagagtgacaagtgtgagtatatttattggtcaatataaattgacatgttgaataacatataacatgaaaaggatccaccaatttaatgttttaagcttttgacttagatgtaatgttaagtttacttgaactatttgttcatactcattaatgaaagtctgccagtgttttaccttttcatgttccataacactatatatgtagttgaatccataattgaagtatcaaaattgtgcataattccgtgtatgtttcatttagcttttggcatttgggattcacgtccaacttgaagcatctaaatgttatttatgcgtccataacataaattccagaagcattaagttttgcctttgaggattattgatatacactctaaaaaccccgttgtggccttgttcaatcataggcatcctattgaaaccgttggttggctcttgcaaagtgaaaagtctaaagttctgccctttttcttctcttcgtacatgtctttgaagtctttcggcttgttataaagggaactgttggttagcttttataagtctttttgtatacagggagaaaattttgataaaagataacgtgcttgctccttgctggtcaccccaataataataaaaaattctttggaaagagaatgatgaggatatgagtgaagcaagtatctttcaaaggttatcgttttcagaatttaggttctaaaaggaatttaatttctaatgaaagaaaacgttttaattagcagttcgtaaataataatgtaaaaattgaaacattttttttaatagaagcaagattaaatagagttcgaattagcacgacattttttaaaagaatattcctatttaataagtggtattgacgatattaggatctccctaagcattcaaatgtttgaataaaattctatggcccgcataaattttgattttcttttcgtttcagctgaatcgtagaattttaatactcaaatccatcggttgtttggctttttatttagaaaatgagttatcacctttacgtagaagaagaaaaaaaaccaattttcctacaattcctgcgacagtggtggtcaatgtcaatgccaaatgacgatagcgagatgctaacagtgatctagcctcgacaactgtgataaggaacgcatataagaatgtggcaatattaatcatcatagttattggaaaatgtcataacaatgactttaaaattataaaagcaacaatggtaaattttaattttaacttttcaacatttaacaccatagttattattggtaaaaaaaaacaccatagttataaaatttcatgttcagaattaaaatatatctaatataaattagtaatattaattatgacatttcccttataatcaatatatataatactaattttgattttttttctaattttattttgtaatatttttagtttattgtttcattttatttttattaacttttcatttattttatgtacatttttttaatccttataattattttaaaaaaataacaaagaggattatagtaatttttacataatatttttttattataaatacatattatatagacaaaagtaatatatatatatataagtatatatacaaatataatagtcattaatataattttttttacttataatgttaataacctcacaagttttaataaaattaaaataacatttacttaacttaatttttatatatttctttgatattcattttttatttataagcataatattaacataaggtgagtctaattcttgccaaagccaataaaaataaataattatttaatttaattctaccttttgtatgcttcattggtactaaacttgaggtttgtttaagctaatcttattaacaaaagaaacaagaatatcttatcaatacttaacatttttttaaatagagatctcttgagtagtatagtgatatagttttttatttaatttttttgaaggaaaaaaactactcatttgatccatataattacacaaactttatcttttagtttgtgtacaagcacttttggattatttttagtccctacctttaaaaaataataaggccattaaaaggtaaattttgtataaccgtaaaagtaggaactaaaaaagatataaaagtgcttatatatacaaggactaaaagtgaggatttttaagtgtgaaatctagaagataaaatttgtacaagtataaggactaaataagtagttttttcccttaattatttaatggagggtaaattattttatatagtaaaataataaaatttaaatgagataaatcaaataactaaaagttgtcatttttttaatgttattttgcattgacaatatatgaaaattaaagtcatatcattattaataatttgtatataattaataatataaaaatagcattacattttttctttcgagcagtatatcgtacgaccatgaaatctagttgtaatttcaatgtattcaccagataagatgattaaaattcgaatgtaacaactatggtttgaatactcaattccaaagttggatgtctcacgaagtgtaccttaatattaattgcaagttaagaaaagtggactcgttaaggttaagcctccaaacagagggcagtgtctgtctttgtcttggtccctatgagtctgggagcggacaaaaaagagtgtttcttagtcttaagaaataagaatgatcccttcatagatgcctaatcttgcacgttatttttctgccttcttctgtactccctccctagtccccccacatcattcattcaaatccacatcacactagggaaataaaataggagacaattttatgagttaatttatttataatatataatgaactaatatattttatagattttattttcacaaacacttactattttaagctagtatatatgtagaagtctaatgttttgtttagtgaaggagatgaaaaaaaatattaatttaaattaaaatagagtataaaaaatttgaaattcacactatttgaaattgtctatttccctcttactaaatggaggctgagagatgatatgttaggtagtctataaacatcaacaatgcatctacaataagaagagtcgtgttatgggagagtgtgatccacataacattaagtatcgttttacatacaaggctcgtgcatgggggatacttgagtgagtcaagattggaatatgaggctagctagtaatcgacccaagttgtgatctaggattttgccattgttggcaaacacgaaagttgagacatatagcagggctaaattcaatatggtcaaacgtgaattatattcaaattataatgtaaatttatgaattaaagcttcaaaaggaaaaaaaaaaaaaagattgatggaaaatattattttctaataagacccaaaaaaagacattaagtaaaatttatttctgaatgtgttagacaaggcatgttaaatgggtcaagaggcttaacattgcaattcaacctaccaaaataaatgggttgactattttcactcaatggataagtttgttttaccatccctactaacacttttaaaaaaggttggacatttctccatatttaatgttatatcatattcaagtaatcttattaatataataaagatatgagaagttataaagagttataagtttattaatataataaggatatgagaagttataaagagttataagtttatcaatttttttttttaaaatacatttgtccttaattgttattagtggtaccaatgaactgaatcaactcaaaaataatttgaaattcgagttgataatcagttcgttaaacttgattcataaattaaatgagttgaacttgagttacgtataattttacccgtttggtttatgaattgactccacacatgcacatacacacacacacatatatatatatatatatatatatatatattaaatttttataattaaatgaattttctattattttatgtatgcatgatgaaatagttttatttatattaattttggttgtaattatgattttttattgttatatcttatagttctataaaactagaatacattcaatttttttctttaaaaaaataaacaattattttatttaaaatctactaataatttaaaattttaaaacgtataggatttaaaaatttggactattattcatattattcgaactaacgagcttaatcgagttattcacgagtttaaactaaatcgagttcgagctaataaaaactcaagtcgagtttcgaactaaattaaatattaatgggttgagttaaactcaagtgagctcaactcatttttttcccataattgttatttatgtattggtattgctatttatataaaataaaactttgtgtattagagcttgatatctcatatcccatctacccaagatagtagagtattgttgagaattgagaaatatggtaaatcattcttattagataagattaaaagatattctactatcaaaagaaaaacatgaaaatattttaataaactaggtcttgtgatttcttctttacatatacattgagaaaactttttaccttctgctcgtacacttatttgacttccatttcatgtctgttttaatttaacatcataaataggagaattaatttggtctattattaattttcaacacccaaacgtcctctcacgtgagtgtatagctttgtgcttttcagtggtgcacacatgcatcatgtggagacatgggttgaggattggaggattgtgtttgtgggctcagagaggaccagcagaaattaattaaaagagatattttggtggccattcaattcaccctcgaagtttcatggactggaattttctgtttgttggtagagatagagaaatttcagagcttcttcccatacgcattttaggttgccacaaattcgtcatcaaaattcaatatagacaagatatgtatatatacacagcaagacttcttcaagtccacaaaatgttataatttttatatacaaaactaatttatattcgtgcgtgagagaagatttacgtgtatttattttaacgcgtcattcttttcttctttctcaagttaaacgtatgtttttggattggttgaaaaaggttttgatggagactctagtacagaactatgtaaaaattatgaacaactttttctatttactggtggtatttatcaatttgatttaagtgattatttaaaaaaaatcatttcttaatcttagaattaatttatgctaattctcatattcaaatggatatatggccaggaaaattaataaaagttcaagaaaaacacaaatgaacgataactgaagtttgtgaaatatttgggataacattaaagtttgaaatgtttatttacgaaaaacataaaaataaaagcataaaaaatcgttgaaagtaatttataaacaaagttagagggggaaaaacctaacaaagtcaacatgatcgttgtgagcttgagggaacttcacgtacacggtaaatcatattaaccatttttatattagggtaaatagatattttgtcccttaatatataaagtgttataaattcatatctaaaaatgaaaattcaaatttaaattttagttatcaaaaataaaaaaatgtcacaaattcattcatctgttaacacgttaatgaaagagtctatgtggcatattcagagacaaattaatgggtgaattttgttagctctttacacattcaaagacgaaaatgactacttacccaaaatataatttaatttttatttttccctctttaattgttacaagcataatattacaataaatacttaaaaaaatagaaaaacaagtataaattagaacaaacatattaataagcatagtttatctattattataaaatttctaatataatagtaccttacacaaaatatgaaattcaaaaaaaaattatgataatgagacctaacttgtttttgttattacctgtcataataaaaatttctgagacagattatatttattaattaatattatgtttattattatgtttgttctaatatatgttttctttcctattttttaagtgtttattgtaatgttatgtttgcgacgattgaaaaaaaagaaagataaagattaaattatattttaaataaataatcattttcgttcctgaatatgtaaagtgcagataaattcgtctcttaaatgtgtcaattaggctctttcatggtaacggacaaaaattaacgaatgaataaatttatcattttttttactttcaaaaactaaaattttatttttattttttagagataaatttatccatactctacatactcatgaaaaaaaaaactatttaccatttatattatatagttatagtacttattttagtcttttcgtccacgggaaagcaagatttccacgtttttcagtataaattttaaatccgcgagaatgagttacgtcatgcgtgaagccgtgaatacgtgattggcaggctcatggggataaataagttacttgttgcgaaagttcatgtggtactgcttcagccaataggtaaatgtgctaacaagttacttgagaaagtaaaagaggattttttatgattattataatacataaaactacatttttctatcatttacagatacatttttgtataacttttaatatatttttaaataaattttccttgactagtttcaaaaaagcaaacattgattaaaaaaacccttggcaatatttcatagaaaaatattgacgtaaaaagagaattgtttcccagcataattgggattggtaaacacttcgatcggtggattgttatcttactagtacttctaatttttcaaacaaaaagaaagtttttttagcatcccaaatcttacttcagcggtggctaattatgaatctagataagagaaatgctactaacattgttcgaatatattctcttaaatgcagtatttttgttattaaatgaaatttatcatattctttatttaatgaaaaataattatgattttgtaatttaaataaattttaattaataaaaataagttaaaaaggattttttgaaaatttaaaatttcaactaataaaaaatattatattcaaaaaaatgtattattagtatttctcttaatcctatctatctaaatcaatactaatggttgattgacacatctatactcccttcatcctattttatttgatattttaacaattttttccattttgattgtgattttacaatattaataaaatattaaattttgcattatatatttaatcatttattgtaaagtgagaaaataaaaaatatacaaataaaaaatctaattaatataaaagacaaagaatatataaaaaataattacatgatatcattcatgaaatttaaaatattaattttttaggtattcagataaagatattatttccttttcgtctcaaactttggcataaatctaagctacgatccaataaaaagaaaaaggatctaatgaaaaatatttttaatcttatataaatgtagaagaattttttaataattgtattttagatataatatttattaatttatagtaatttataaatcggtcaacttgactcatgatgaccacttaatttaagaagtagtctataaatttatttttaatgaagtatgaccatttatgtaatgtcaaccgttcattagttaaaagagaaaacaaattatataggccgacaatggaagtggaagaaagattaattcggtgtaaaataaaaatattaaatatcatttataccataaaaaatttatgcctttcaatcacaaatataatatataataaatttaccgattgaagaattatgttaaaactcatgacaataacttttaatttattaattattaaggtgtcaaaaaattacataaaaaaatacatatagatagtttgcttaaacttaaaaaaaaaagtgattttttattaaaaaatactttaaaaaaacttaaacaaacaggtcaaccattatattctaataaaaataccccatcaaggaagaaaatttaacggggtaccggtggagaaaaaatgaataatgattaacgtacgactggtggagaaaagatgaataatgatgaacgtacatatggtttttagacgtctagcgttcaacccaaaaacttggttaattatatgcataaatatgattaattttgttttataaatagtttaaagtaaataaatatgaatatatataatttgagtaaaatttgacaattagtgaaagaaaggtaaaaataggtattatagattttatgatgtaataaaaagagaaagataaaaataaaataagagatattaatgggtgtttaagtatcattacttatgcataattatgttatataattatcattaattttttataaactaataagttattgattctaatagtattaaattttctccctttgaatataagacttcatatttgattcttatgaatacttggtaccaatattgtatgcataaattttttttattaacatacaaggtaaaaaatcaaccactatcaaacattttaataacttatggctctattaaccacaatgtctaaggtgatcaagtgagttaggtggtttaaggttgacaaataatttttcaataatatttattaataaaatattaaacggttaaaatgaagtatttttttatcaatttatattttatattgtcttttatcacaccatccttttttcttgttccttggtccttttcctctctcgttcgctgtgcgtcgttattgtcgacgtcatcactaccttgttttattttcccttcttctttccctctcttcaatttgctgcattcgccatcatctaaaggactgagagaaacttgtagatccataaccatctaaaagtgagagttcaaaccattgacataacgacattaaaaactagagacgagcatcaacaccgtaatttaacaaatatgaagatatcattatcactcaaagcattatgacatccaaaaatagtgagaaaaactagtaaagaaaactaggtcattttcgcaaacatgttaccctctctccctcttcagtcgttctttccacctcccccaaatctggactctcaaaagtgttttgatgtcgttttcgtggaggaagatgagactgacaacgatagtgattccgatggtgagaccagtgagtccttccttgaggttgcagatggtgagaatagaagagaccaatgatgagggatgaataaaaaagcaaaagggatagaattaagtcacaaggattaaattgtaattacataccactataaaaactagtccagcatggatgaggggctaaggtgggtcaccgtcttcctaaaattttattaatataaattttattatatatatatatatatattaaaaattaaaaaaataatttgacaataaaaaaaggttgtattgtataatatcatatgatacaatattttttaatattacattaaaaatagaaaaaaatatttttgagattacattgcataatataatagaaatctttaagattatattacataataagataaaatattttttaatattgtattcaaaaataggataaaatatttttaagattgtattgcataatataaaatatctttaaagttgcattgcataatatgatagaatatttgtaggattgcattcaaaaattggttaaaatcatatacttaaattagtataaatagaaacatatttttgtgtttatagtatgcattccattctaaataatattagaactttagagagtttatgtttatctcattgagagaattgttatgagatcatatagaagcattttacaagtctgattcttaactctctatcaggatttaaagatacttatttattatcatagtggagttgtccattggattgattatccaatttggacatcgtattttttattcaattgggttttctacgctaaaactaattgtgtcttctttatcttttatctccatattattgttttgagtttgattttaaattctgaattttttattaagactcattagactttgtttgcttgttcatcaaccccatcttatttgcaatttgtctatatgtaatttgtgaattgtgatttgcctctttttgtatattagatttatattatctttaaaatacttttatttatgatataattttttttatgttcgtcccttcaatgaaattcttatgtccgccaccagcataaaccacattgcttactagtccatcgtacaaggcatcctctattaactacttgttagagaaacttaatcatgattagatattttaataacttaataatcttcactcttaactacttatgatgagaagaaaaaatagccatatttgaacatgtaattaatcatgtgcagcaatctaaaacgaataacattcttaatcacttgtaagataaagtattatataatataagattataaatcacttatctacatttatttattattaactatttgtaacagaagattaatcatacttatacatttgattaagtgtaaaatatgagtggaatgaatataccgagagaagattctggagtccaagattccttgaaacgggcctaacctaaatacctaaatacctaaatacctaaatacctaatctatcgcccattggttacgcccacagcacagcacagtggtccactggtccactagcgtctagcgaggcgaacaaaaaagtgaagccacctctctctttcaattattgtctcttctatcggactctgtttatttttccaccaaggcaattttttttctttccattcattcatttcactccgtacgcattattcacggccacatttaaaccacatctctcttctcttatctataaaacaagaaacaaaggcacctcatcctctcacaccacatccaccaaagcagagctagtttagttagttactcttttctgcatgttggttctctcaacaacgactcctccgccaaaaacagaagcaaaacaagattattcattatttttgttgggttgaatccccgggttgaagcgttgcagacatcacggctattctaagagtctctcgctccctcattcatgtcccaactgtacgacggaggacgggtagttgcgtaacttccgccaacccttcgccgcacggtgggcgtggtgctttgccttctgaaggtggtagcccttcagacttgctcttcctcgctggtggcggtgtcttctagtttcttcactctttttattacttttagcctacatactcttaaataagtaaaaaaaaaaaaaaaaacaacagactttgtgactagttaagatcgccgtttcttcttcttcttcttctactttcgttcacaaaatgatgctcagactcaagagggttcccactgtcgtttccaactaccaaaaagacgacgctgcagaatctcctcgtcctgtcggaggttgtggtcggaattgccttaaagcttgttgcattccaggtacttctttctttttttctttctccaactcatatatgcatgtgcatgtaacattcacggttttttttgtcatcaataactctctaaagttgagttggatccattatacatggctctttttttttttagttatttgtgttttttgctttgttaacagatgcaaagcttcctttgtatgctttcaagaaggctaatggaaaggatttggccctgcatgcatgcgccggagagcctcccctcacattcctcgactcacttcttcttggagaggtagatatggaattttgctcatggagaagggttaacaccatcttttcttgttaccctttgtgttaaagtttctaatttttttttttaccctttcatggcagtgggaagatcgcatgcagaaaggacttttccgctatgatgttaccgcctgtgaaaccaaggtctgttttgttttgtttttgtcttcctatgcatagatatatggatggtatgatttctgagtttgatgtgttttgtggtgattctgttgtaggtgattcctggtgaatatggtttcgttgcccagcttaatgagggtcgtcacctcaagaagagaccaactgagttccgagttgacaaggtccttcaaccctttgatgaaaacaaattcaactttaccaaagttgggcaagaagaggtcctcttccaatttgaagctagcgaggatggacaagtccagttctttccaaatgctccagttgatgttgacaattctcccagctttgttgccatcaatgtatagacactagcttttgttcttgtgggttcattgttaggcgttttatgtaataactgatgatgatgtttgtttgtttatcgattttcttaacaggtcagtcctatcgagtatggacatgttttgctgattccgcacattttcgagtgtttgccccaaaggattgaccgtgagagcttcctccttgcacttcacatggcagtggaagctgataatccatattttcgattgggttacaacagcttgggtgcttttgcaaccattaaccatcttcacttccaggtactggaagctgatcaactataccacttaatagttcgtgttgatgattccgctgtttaattctacaaatctgattgcattttggtgattttggcatgaatatatatgcaggcttattatttggctctgcccttcccaattgagaaggcccccactaagaaaattgcaagtttaaatggtggggtgaagatatctgaactgttgaattatccagttagaggtcttgtcttcgagggtggtgatacgctggaagatttatcaaatgttgtttcagatgcctgtatatgtcttcagaacaacaacatacctttcaatgttcttatctctgactgtggaaagcaagtctatctgttaccacaggtaaactaattcttgaagcaagtgaatttgcctaatctattttcattagttgtgtgggggtatttaccaaatggatgaacagtgttatgcagagaaacaagctcttggagaagtggatgctgagcttcttgacacccaagtgaatcctgctgtgtgggaaattagtgggcacatggttctaaagaggaagaaggattatgatgaggcatctgaaggcaatgcttggaggcttcttgcagaggtgtccctctctcaagagagatttcaagaagtcaatgatcttatttttgaagccattggctgtggtgaattggaggatgtcaatgttcaaagtgtcaaagaagctgatgcagtcagcacaagcgaacaccctactgtggtggtgggttgtgaatgtgtggttctacagtaacaaggctctaacattatgagcaaattcagcaaatccgcagtgctttaagaataattgctgaattgtgtcaccgtttaagtcacatagtagtgtgctgtgcttgagccttaaggtcgtgtgttgtatgtatttgcttttatctgcctttatgacgcgttcatgtgaaagtacgatgtaataactgctcacctgagtactgttgttggtgtttagaggtatgatgtatcataatgcttgacttgactgtgagaaataataaattcagtaatctgtttgtccttgtagtagttcttaaggatgaaatcttcacttgctgtatttctggtttccctttgtagtgaatgttttatgttatgggttaagaatttggcgagaatctttattttatttttattgctgttttttcaatgcctcttggctgtgcattagtgcttgatcgtttttagattttgatagaattgattatgaattgttgattgtttcagattttgttagaattggttgttaatagtttaatatgattaagaatgtgttgtagtacaagaaatggattaatgttgtaaatcatagaggctatcaatagattgtttaatgagttggtcttcaaattgattgcatgatgctgtcaaagtgctatgttgttttagattctgtcatttagttattgtatgttgtcgcttataaaaaagaaatcattacatgcttcaagttgagcatagtccttagacagtgcagaactttttaatttttaatttttaatttttaatttttaatttttaattcatgttaagttggttgcgttttgggacagggcacatactcatctcatgtagggacatctgccactcaaacgctttcagtaattaatgatgtataatgtagcaattaatgatttggtatgtatcttcctcaaaaaaacactgaagtattttaatttaggcttaattacccattgcatcgtcaatttagtagtattcagcaccggttcttgcatcttgagtattcggacagaatatcttcaacacgcacaaagcaaattctggtgatgtacttgtaaagactagcgttctaagtcagtacataaaggatacaaatgggtatttaaaattagagagaataccttatatcctatatgatctatttatattatttcctttttacatatttaactgatgtcatagggaatttgggcaattcttttaattgtttccttttaagctttctaaagcttaaagtttaaaactattttttttcctcttaagatttcataatcataaaataagataaaattaataagtatcaacattcagctgagcacataaggtgttacaatggactacaaacagaattgagtaagcttgaagtcctgaggtgcgtcaataatattataaaaataagcttgaagtgcgtggttggtttcacgttggaatgtctcaaacggccgttgaattaaaagttttgaatttttacttttcacaaaatgtgcatgggaatgtgtgtctgtttaatctaatattaaaccaaatgcactcgaaatcttgagactcgtcaatagtattattaaaactgtccgatcgtcgtcacatgtcgtctggatagctttattttattcactttgctttcttatttggtattctttcttgctttttatttatttttaaatcgtgcaatgcacatgtttttcaatgctaataaatcacaaataacatacggagattcatgaggtagttacaatcttttcagaaaggcatttcaattttcatgtgaatcagttcccttcaataacgtaacagttcatttcatggttttgcattcatcatcatgttttacaatcctaaatcacgcaaccttgttttgaggatcaacatacaaatgttaagcctctcaactcattatgcaaaaagcacagagctagctgacaaaatattccttctagtgtatatgtaactcgaacacatatatagacaacgtccaccgcccataacacgagatcaagaccatggttgttattcatgcaagaaaaacatgcccctttggcttgtaagaaaagcaatttactttcacataaacatgtatgtatgtatgtatatatatacatatatgtatgtatggatgtatatatatatggttccaaaatgctacccttcaagccacttcctcaagatgagtctaagagcacaatcttcagctcttgtaacattggtggtggtgctgttgctgatcaagatagagggaaatccaacaccaaaagaagtccatgagaatggcactgatgcctcatcttcatcaacatcattgatggagaaagatgagaaccaaatcattggatgcaggggaagaccactgatatgtagcagaggagagtttccaccaaggtctatatgctgtggagaccgttgtgtggatgtgactacagacagagaaaattgtgggctttgtggggttaggtgcacgttgaatcgtcaatgctgcaaccgtttgtgcttaaacacaaatgtgaacattttcaactgtggtaggtgtggaagagcatgcccccttgggaggttatgtgtatttggattgtgtgcctttgagcaagcagtgccaacgccaacgccaacgccagtgtcgccatcaccgccggtgtcaccatcaccaccagtatcagtatcaccatcaccattgtttcctcccgtgcctccagcaaagtcaccacagccaatagattaccaacctgaaatggattaagtattgttgtaatagattgtggatggggtctcttggttacctctcccctgctttgaagttcgtatctttgtcattctaaaataagtatttaagcctttattagggttttcatgtgcaactgtttgtgtcaagctgatgttggtatgaattatatgatgttgcagttacatatgatgttggtttgatactttctttgttagtagcaaaacatgttaattttatatgagaaagaacattataccgagtaacttcctggtttttgttggctgacagtggttgaaggaactaaaaggagaagtatttattgtggagaccatacgagtgcgtaaaaaaggtcatggacaacataatctaagagcactggttagcatttgcctcaatagtattattagattaagacattttaaagtacttatatcgatcatttaaatatgtaatataaaaatgacaaattcttacatatgatgtcctctctgaggtcatttataacaaacatgatatgccaatgtctaccagttatggttttgtaattcatgaatgctcgcacatcttcaaatttgaaattatttatattcagtaattgttacataaaaataaaataaatcatttatatgaactacagacacaattagaacaattatgtatgtatattcagttcaattcaattctgagcgttgcacattcatacaaaggacatgcaacatcttcatgttttaagacagttctcctccttcagattttttccttttcaggacattggttatgtgctaactgtgtcttactttccgcttacttgagcttgaccttgggacttctcagtttccactattctctttaaggagtctttgtgatttcgtttttttagctgtttccaggttcttcctcagtaaattaatctctctaatatagtaatgttgtctgtcgatcaccaatccaaggaacagagagaatcctgcccaataattaccattttataggatttaaaactcatgttctgcacataatagtatatcagaagtgctaaagagaaatctatattcattgatacttgatagaattcatttctcaattaaatgcattgtccaagcatgagtaatggcaaaatatgctaacaaaaccggattataaggttggtttggtggtgaaaggaaaaggaaaaggggaagagatcgtaggtttgaatctcttaactaataaaaaattaattattagtaactgacatttgccgataaaaaaaatgtcaaaatatgctaaagctacttttagttagcacatattcaaaactataaatatagcctcttcaaataattaatagagaattttattggtgggcatttctcaattctgtttgccacgagtcaagcctagagaaacatttatttgtaaacttcatagtgaaattttgatgatttcaaccttcttgtcacctttcagagaagttatgaaactaaacagatgcttacactagtacacgtggggtaagtaagttcgctttctgttgtgtgtaacaaaatagtcctgcagatattgtaactttgtaagcaaacaaggaatgtattttttgagtaattacccaagaaagctgcttccaagagacgatgtgccatcaacacctcatcagttggattaacaatgccagcatccttggaacgcttttggattttgattatagtatacacggtggagctcaagaccacacacatagttgctgctacagtttttgtgactaaggtgcccctcccctgcttcaagaggtctagccccatgatcaccaattttcgtattggatttgcaaaagataatattaagatgaatgctatttggatcatcaaaagtatgaataaaagttgtatcatctttgtagaacttcttaaatgttgatttctgtggtggaggtaagatgagagcctggatgaaaaataaactctttattttgactgagtaccatgtgtttataagctgcttttggagacttgtgaggttaggcgaagaattatgccatgctttccgttccaagaccgcagcaggcacagaataactttgaacaagaggaatcagtcccaacacgtttgatgagaataaaactgaatatggcctgcaagcttgagtgatctctaccttcccaattcaattatcaattacctctcttttcactttttcttgagaatataaaaccttgccttgatcatccaagactttttaccctgatttttttgcaatttacacaagcatattatatgcaatatatactagttttagtacctgagcaatacaaaggacgtatgttgaagcttggcaatgttgagaagacaactaacaataattgatatacaattattatttagaatgatagaatgaaaccactcttcatatatttatcaccatgcatctctcgtcaaccatttttcatgttcccagcaaacaaactaatttgcatgttgaattctatgcatatttttttggattaagctcttaattaacaaaaataaataaataaaagcattttttcacatgagaattattaacttatagaggctacattcgatgtggcgtatataaaaacccgggaattctagaaggaatttaattacggcagtgtattattgccaatattatatcatccccgctttcttggaccctatgatgatatgtatctgaaaattttcatccgctaaaaaatagtgtaagaataaagtgccatgaaaagaaatcgtcttattactccaggggcaatccctacagtatagttcatagtcgtttcatacaattttggagccaaaaactgtgaccctcttcatattaaatgagaggaatagtgggtagaaaaaacacaaccatgctgaattaatatcgaagggaaattgggatatgatcctaaagagtttgctcattacagattataaattacgggcagccgcaattcaaaacctaaacaaaagagaacccattatggtatttgaattttgaggtttaatttactccatttaaaattagaggttcagttcatatgtcgagcagaagcctgcgaggatcctccacaatatctttgatgcgtcgcagaaagaacactgcctctcttccatcaataattctgtggtcatatgttagagccacgtacatcaatggtcttgggacaatatttcctccaacaacagttggacggctcactatggaatgcatacccaagattgcagactgccaaaaacaataactgcatgagttttctttctaaataattaatttcatattttattgttcacaataattagcatcattaaaaaaaacaattatacatatttaactagtaagggaatagatcagaatatttggcttgatatttagaattaaactgatccttctgtgaaaacaaattgcatattgaagagttactggtgacaaaaataatgaccattttcattaaatgataaacaatgcctgaacctaccaagatagaaggaaagcaatcaatgattatgtacaatcatatacatacagaaacaacttcaaaacatatcgaagaatgtcttacaaattaaagaaaaaaatataatgatatttatcttagtataacttccaaacctgaggagggttgataataggggtgctcaaaaggcttccataaacaccaccattggatattgtaagagtgcctccagccatctcatcaattgataaagttccatcatttgccttctttgcaaaagcattaatctgcttttctatatcagcaaagttcatggtatcagcattgcggataaccggtacaacaaggccctggaatggcgattgagggtcaatatttgttcaaatacaacatgcatgttgataattttcatggccatgcaaaaaattgcaaaattagactatatactagatcactagtaaattagctccatagccatgacaatagttgacataagttgatcacagagatggctaagtttcatcaagacagtataatgattgattgatttctcaacgtaaacaaagtaaatgagaaaagataaaggtggctgataaaaaccttcggagtaccaacagctatgctgatatctatataatctctgtatataatatcatcaccatcaatgacagcattgacaatcggctgatgttggagtgcattaacagcagcctaacatggagaccataaaaagtgtatgaggaaatcaaaaagggaaaacccagctagtctatacttcagtaattagaaaacatactttgacaaagccagacataagccccaatttgactccatgcttttcaacaaaagcatccttataatcagaacggagcttcatcaaattagtcctatcattaagagcagagcaataaggaagagaatgataatagtaatccactatataaggatatgacaggaaacacaacatcaagaattgacaattaaacacatggaatcactctttttgattaagtctacataataactgaattacattcctccccctccccctccccctccccctcatttaatcaacagaatatcccacgatactgggtgttatcgcatagaaactactcagtggcataatgtaaaattacatagatgagcaaaaagctaagcataaatgcaagaagggaaaaatgcttcaaccccaatacatataagtcaatcgtttccctatcttcttctaaacaaaaaaataagaaatgtacaccaactaagacaagtagaaattgagagaatacgtaacaggtttgttgatctgacaaagaccaagaaaaattaacagaaatgtaatgactctccaatgtatcatagctgtagaggacagaccatgggttgaggacttcattaaatttagacaactgtgttccattagaaccatcaccaaataatgtaatagtgcatttttatacacacatggggtaaaaaaacagtttgagcaatattaaaatcatatgctacaatttgacaatcaacaaaacttacatatcaacttcattgaaggttgtcagcatagcaaacgtgttttgggaatctttcagccgtgtagcaactcgtttccgaagccttgtcataggaacctttgataacaatggaagacattaaaacaactttcatggttgctaaatataattcaggtaggaccaaaaatcaaaatgcctcactcgtctttctctttctttaggaggaagctggggctcggtgggagacttcagaatggcaggagatgctttgggcttctctttagcaggagcagtttcaactttgggagctttcttctcctcgctaaccttttgggttggctgaggagcagctttctcagatgtagtctcagatggggcaacgtgagttgcatcagcagaccttgaaatgattgctatcttgttacctggctcaacagtatcaccttcgttggctagaagctgcaaatcattaaatagatcacacaagccaaatttaataaaagagaaacaagaaagaagagagtaacaatttcttcatttcagggtggttgaggagagtaaaaacaatttaaatctatgaaactgtacctttagaatcacgcctgactcaggacttgaaacatcaattgtcacctaattaaggaataaaaacaaaatacagcattaactatttggaaatcaagaaaattaaatgtttataaccatcaaaatccttcacaaaaatttgcatgttgctttgacatagcaccttatctgtttcaatttgagcaattggctcgtcagcattaaccctgtcaccaggtcctgctcccatataacaaatcaaaacacgacaatcagtcaccaataattcataaattaacaattcaaatagatgacgaaaaaaatatacaggataacatactcttcaaaaattgtgccagagttccatcagagatagattcagccaaaggaggaaccacaacatcaaccgtatctcctttatcacaaatataaattacattagcaatcttaaaaatattaacaatcaaaagccaaaataaaacaggttaattaaacaatgtaaatgccagaaaaatgaatggtacattaatagacgcatcaatagggcaataaggcaatagtgtcacatcaatagctcaccactttctgaagaaaatagacgcccccttgttcgaacggttgcctctggatgaatgaccaccctacaaagcaataaggcaatatcagaacagcatcactgtggataagaaattgtaactattttccattccatccgattattaattaatgatttgtcattattgcacccccgaaactccatgtgaaaatatcatcaacagaatttgatcgagtacaaataaaactatagaagaatacagaaaatgcattagtgtctacttctttttttcttggaaaataaaaatcatttcaaacttgcatctcgggacattcaattcccttaataacaccaataaatttaaatacttggttttttctaagaagatgaccacatgataggaatgtttatgtgcataagctagcattagcaacatacaagaaaaagagtaaaatttgcagctaaataatactgaaaaaggcaaggaaatattagtacaaccaaatttgtcatgactaaaattaaggattcgaatcatttgattggctaaggatttgaaaacaatttcatattctcattttcttactatattttttattaccaatccattttttcctcctgaagtcagtaaacatttctgcattactttatttttgttctaacttctaactatatttaaacaataagattgttgttgaagcttccaaacccaattctaacatttgaaagccttgttggagagcttgatcttaagtttccagactccagctaattttaagcttttgtataactaaaacatgttttcaattgtatttgttattttcaaggaaaagattaaagacaccaaaattctaaaccaagagcacccttacaatctatcctatttctgagccgaacttttttacataaattaaagagaatcctaaagcaatgcttaggactattaaatggtgccacgaacctcataggctttgaattaatccagcttcctgcaacaacaacaaaatttatgatttaaattgcaaaattgcataaatcattcaagtaattaagtcaacagcatctaaaatatttaaaataaaatgtacccaaaattaccaagtgttatatgactgaagttttggacaaatccacatccgcctgaaggaaatgcaatctgttaaacacaataaaacaatagttgtaagaaacttcaaaggatacaaataacatataaattccaaaatctaaccctctataacaaagaccataagtaacagtgggaaaaaaataatgaggtcatcacctgtatgtaggatacagtatcacagaacgataagtgaaaaaatcatgtgtgctaattattacttacaagaaatattttttagagaagagagtgcaaaaaaaataaaaatagataataagattgtcccaagaaatttacattgtgtagtctgtacacaaagcaggcagtctatatatccattagcaattgccatactttgctgatataattgagtaaaaaaaaaaaagtaaacttactctatcacattgaatttgaacaaccatatgttaatcagaccacattttgaacaagattcaaacaacacacaagagaaaaaaggtcataaacagaaatgacgatgaccaattacttttcaaactgttgaaaaatccagaagccatagatgtaggaaatagtttcaacgtcaaaaaagaaaaagttagaaaatgaaatgcaccagattaggaacttgccaccaaggacaaaccagatgagcatcagagtcttttcaggttatgaaagaaattttatcaaaaacaattacaacaattaagcaagattaggaatttgccaccaaggactcgacccaatattttcacattctatttgtccaggtagtacatttaacacatatcccaaagggttaatatgttttagtttctataaatataattcgctcttacacactcaaaataaaatagtctcattttggcggtcccttgtttatggaaataggaaccacatgtgacatttccacaaatgagcgacaaaacgaacaattttattttgaaggactaaaagtgagcactaccttatttgcatatactaacaacatcaccctatctcctaaacataatatttgagtaaccatcagtgttaacagttgagaaccgataaccatcagtttcttataagttataagaagaaaaaacatatcaacagagtatatgcagaaaataaagacaaacacctctttttccgcaatggaagaagctctagcagaaactgatgggccagaccgaatcttctgaactgactgaccaagcaactgaaacaaatgcagaacaggcatcaaacatgacttaaacttaaacttcaatctgtggattaacacaaacacattcaaattgaaaattcatcatgattcataagcgtttagaaaagaccgagctctcacccaaggaaacgggctgccagaagcaacccttcgccttacgacaccaaacatgattacgcagtcagaaatctcttcttcgtccttcggacttcaaacctaatttgacaaataacaaattcaaccaacaaaaccataaaaaaaaaaaatcagactgaacggaaaatgcttgcatagataacgtctcggattcattacgtttctaaacaagaatattaacaacaacaacaacaacaacaacaatacacctattgcgatgtattttcccgattcaaccgttctagacgcagatttgcgaaattgcgctgcgaaaaaaaatagaaaagctaatttctcgggaaacagagacgaacctgaacgccaaacgcagatggaagggtagggttgacgatggaacggagacaaaggagatcgccgcctacagagttctgaagaacaatagtattatattcgctctctataattgaatttcttatgtctaatttccctatcttttcgttactgtcttgaaaatactattttccaggtcaaatatcgcgtgtttcaaattttaaatattataatttttcttcctcacctttggaaaaaaataatattatattatattttcttgattaatatttacatttctctaatttaattgttaaaatgcatttttatcaatcaaatcaatttatgatattttcgaaattagtagtttccaacgtctgaatctttgtattttaattcatatctttttactgataaaataatctgttgctaattaaataaatcaaacctttcttcatttttttatttaaactttgtatttttttatatttccaatcaatcatggaatgttctagttatttgtcagagtacttatgtagataaaaaaatgagttatacaaagttaaatttcattttaatcataattttaaaaataaaactaatgcatctgacttcttggattgaaaaatccattagcggattgtttcgaatatatccaaaaccaaaaaactaataatcaataaacttatcatcaaagaatgtctttatcatttattttataattattataaatcagacacacttaattatgaaatttttaagttataatctattaaaaatatatgtattttatttgtataggtaatagtaattaatttctttaagtcattcttaattgtacagtctcagacctacacaacttccgaatatctctcatccgggtaattcattcatatatccctcccgctggaagcctgctagtagaggtgttcgaggtctggattggatcggttttgaagcaaaaaatcatctgatccaatcccttcgattttgtcatttgatcatccattcggtttgaaatttttttcaaatccgatccaatttttttcggtttggattggattggtttttgattttttaaaaagtctaaaataaaacttatgagacttatttttatcaaactaaggagtatctagcaaaaacaaacaaatttattggacaaaaacaaacaccattttctaattttcattggacaaacatgttcattggacaaaataaggagcaatgtattggatttttggtttttgggctatgatgaggaataagcccaagtaggtaaagggtaaggtaaggtttataattggatcgattttcaccaaccaaaccgaaaaccgatccaatccagtgaaaattttcgatttttttcggttttcgatttttcgattttcggttatttcggttatcgatttttcggttcggtcaccgcggtttgcatcggtttggatcggttgatgaacacccctacttgctaggagtcgctccttgtttgtgacacatctcttgtgcatcgatgatcattcctcacccttgttagcatctaggatgtcacagtttgaacatctaacttctcaatagagagcaaacgattggagaaaatggaagaagctagaagctattcatcttatgagatcatttgataaatttttggaggaataaaggctccaactcactttagaaaaaattgaagttatatatctataacattgcttaaggagtagaacacaaaaatatagatgaaatgaattatgggtgagagctatgctagaagaatttgatcgaaaattaagtctagatattcgtttcatcacctgaaaatcaatttgttgccaggcaaaaccagtttctcatctatccatgatcgttccctgtaatagttttggcactatgtagagtcacaaagtaaccttggatatccatagtggcctcaccgttgtctccatccctattgttcttaggatttggtaggtatcatttgtgccaataaatagtaattgttgttcaacttttttttgttgttgaccatagtgttggtacgaattagttctcatcgaaaacaaagactaacttttatcgggaaccatgagcgcacacaagatgaatattctcctcccaacaatatttattctatacctaaggaccaaccaagattcaaacctagatcacttggttaataacgcaaaccattatcacttatgtcaactgatattcgacttgaaacttcttttgcccgacctttttatttagtatatcattgtaaggtagtcttttagcaccaataagttatatatattagactctgattttttgtctttctttgatatatggtggacttaataataataaaatggtgttttttagtcattactaatttactatgttaaagatacttattttaaataggtgtgttcagtgatagttaaaaatggccaaaaaaatgttagtgaaatttggaacggaagcaaaattgaaatatttaaaaagttgagagtaaaatgcaccaaaatattattagaggcaaaatttgccaaaatataaaagttgagaataaaaattacaattaaaccttaaagttaatcacaattaattttgataagattaatgtaaggctcatttgttttaaattaagaagtgcttttaaaaaatgtgattttttaaaagggaacgacttgcatattaaaaaaatagtttaaacaaacacaccaaaaatcacaaaactacttattttattttaaaattaccaaaaatcaaagaagtcttttgatattcaaaaatatacaaattttgatatattaatttttagaatgaatttcatatgattttttagtagatatataaatactgcattcatcaaacaatctcattcaactcttgaaaaaattgtagactttatttcttatttttcttatcagttgctagacttttctttctttcttcacacttcattctctctcttcgttgaagacaatatatatacatttgtaactttgttcacaaagaatgttattgttctaatgagtttccaattgaaccaatagaaaaatcttcatgttcaacattaacaaataatgacgatcataattttgaacctattgttcaaaccaaagagcaagtaggaaaatatgttaatacataaaggactagtataagaagacatgaaactagaatcaatgaattttaaaaaagaaaaatgattaccatgaagaaaacaatttttaaagaatttatccacaaagagaaggcataaattaagattaaatcacaatttagcatatgaaagtgcctcaaagttggataacattgtcagagtaatatattattatttcaaataattactttacaatgtatttatctaatttaaatttaatttatttgaaaaaagtatggattttacatttcttcaaaatttatcatttcttagtattttttttattgatttttctaattttaaatattttctaaaaactcatgtaatccttttaaattttataaatatataaagtcatttttttagataaaaaattattttaaattcttattatataaataaaaattcaaactacaatttttttattacaagtcttttaaaaaatctattaaatgatgacattcctacctaatcttttaaattttacaagatttttatattagaataatctttgaaaatcttaatccaatacacctaaagagtaaaaaagaggcacttagtatctctatattttttagataataaaataaaatataaaagatggagattaaataaaaatgcaccgtcatcgaattttatatgtaattaatgggttagttctttcatatgcatttaaaatataataatgatagtgtataatgttatttaaagaatatactagtctaaaaaatacgaagacaaatagacatcatcattataatatctataataattataatctttcaaaaatcttaactgaattatattttccaaaaacctttttctacaaatttagttacccaaaaaaaattgtaactaaattaatccccaaatatttaattagtcattagtcattaaattagtcccttccaaattatattatcaccacttcaatcatccataaaaacaaaaatgttaatattttaaaatttcttttaaagatttaatctgttactaaattaaactttagatttcctttttcacttctttaatcctctataatgaccatggtgatattttagatatttggatcactaatttgatgacatttttttatgaaacactaataatttaagattaattgtgtttgcttcatcaaaatttcaagcttgctgcagaagcaccactatctacgagaagtatggtaaggccagactcgatatgccaataatattgttaatatttggaacaagtttttatttataataaaaaataaagtaattatagaatttcattagaatatagtcaagaaagaaatttttgcgctcgatgagaattgagcttcaagacatctcgtaggactaatccatcccacgaagctcaccaacaacacgtgcctttggggggtccaggccccctactactggtcggcaaacggacaacgagctcacgcgtcatttctagcccggattctgacttagagatgttctgtcataatccaatgcacgataacttcgcaccactagcttttcaaccaaacgcgatgaccaattatgcaaatcaacagtgagccaaggagcgatagcctcttttgaccgaaaatagtagaaagaaagaaatactcattgactttggggggacatgtttgttcgtgagataagtgctttgggtatagtctcttggaccctgaacctacgtgcctatgacttcatttctcaagaaatatgcgatgacttaacaaccaacaaatctacctatatacaaaaatcgtaataataagtagtatatgaattgatttgggagaggagaattgagccaaaaaaaaaaggggtaaaaaactgtaaaatacattctgttgagtaaacatcctagttgatttcatgttagcttgactgctccagtccaggtaaagaagttggctgaaggtttgatttggggggaacacctgcagaccgctttagggatcttcgcttttcttctccttgcagagaagctgccatcttctcagggcgaaaatgagttccttccaaaccctgttccggctttctctttaccttctttattaaaacaccgtctgcacccttgacgtgatccaaagaaccacttgaacttcccttagctttttcttgtttaggaccattcaccgaaggattgtgaacccgtgcagcggtgactgcattagaaactgtattgtttactgaagcatgagtatgacaactagagtctgcagctaatcttgctcgcatgggctgttgggaagtaattggactaggatcaaattgaacattctcctttggtcgaggtgccaataagtttttcctcttcattttctcctgatcctaacaataagtaaccagtgagatagaaaacaaaaatcattattctcataagacttaaatatgtttttcatacctgtaatatacttctttttcagtttactacctaaatatttttattattattttactacctgatagtttcaaaattttacttttggtacctacctttaatctaagtccattaggtgataacgtgacactttgttagcctatcatatcaccacttaatcaatgatgtgatactctgttaatttgccatatcatcactcaagggaccgagactaacgacaggtaccaaaagcaaaagtttgaaaatgtcagatagtaaaataaataaaaatatatatttaggtagtaaattgaaatagggatatataaaatcaaaaacatatttaagccttctcacaaatataaaatcctgattgtcatctgtacatacaaaaaacagaaagcaaattctccaattcttctgattcataattcatagttatctatttaaagccataattaaggtaaggatgaagagaaaaattaaaagactcctgtttagtttccaacttagtcatgccacataggtatttgcaggctagaccacaaattactatcgtgaaactcctcttaaattttcaaaactgagaacatgtaaactgtaaaggcttctttgttttaatagagattttagaatattactacaccatcgttatatgctattatttattgcaaaggcataccttatgtctgctgtacagtgctctgcgcctctcttttgacctgcaaattgcacgcttgatcccatggttgtccatgtaaccatttggccataattccgcaagctgaagaggacaatgcacttgaaagtgagaaaaaatatgtttagaaaaagcaaacatattaatttagacaccagaaactgcaatgtatatgcaatacacatagtcacacgcaaaaagtaacacaagcttctgaaataagagaatcattcatgaggactcaaaagaaggaaaaaattgcaataaaaaaatttacatgtgtgaaaaaataattgagaatccttttcttttcaatgtattcaacaaaatagttatcaatcctagatagcaatgcttagcagccaaatctcaagttatagctggatagtgaatagcatgattgctattttaaagattattatacagatatatgatccatcattatgtacataattacatatgctaaacaaatatttaattaatatttcttggcttattcccaactatcaataaaaaatcataggtcttcagaaaaacatacaattaaataaaagcaaaaatgaaggaagaaaaatatctattaagtcagagaatagagatgagaacagagatgggtgttgctgtaaaaatcgccatagatgggaggctccacaggtttggttgtgcagcagaacaaagacagtagagagaagaaaggggttatcaaccacagaaaagaagaggaaacgtaggaaaattgagggttagggttatatacgttttctgaaaatggagggaagtcaattttacacttaaagaaccctcaaaaatgctttttactttaaaggcagaaaaggattttcaccggcttctcagcaaaagaggctacaacagcagtgaagcaaaaacaccccacctatggcagttttgtcacatccgaatgacattctgctctgcacctctgcaattgcaccgcaattgagcactattgataactatggtattgaaaagaaatgatagaagagactttagatagtactaatttagtaattttaacttaaactaggagatatagaaaagaaaataaaatcaaacccaaaggaagaaggtactgaaagtctgaaatttaaaaacaaatatcgagaggaaggcatagaaaatttgaaccacctcagcatacaactttctgatttgcggaccagcattttcatctaacccctggaacaattgcaaataagattcattaagaacaaacttcaaaccgcacaggatctataaaataaatacttaaggttcaaacttctgtacatcaacaaaaaggtcatagagatcacaaatcttgtcttccaatgcagtgtccacactaaaattccttttagttattggtttcccatcaggacgtaattcttgttccccagatgctccagcttgctgctgtagctgaaatgcaggaaaacatgaaaaagcatcccatattaaataaccaaaatcttcattaatcaatcgaaattacagttatttcctgtaaaattacaatcaagatacaacgcaagcatcaggaaatatatcaacaaaactagattgagtttcgtaactacaactaaggaaatccctttccaggtaaaagttatccataagtaaacatgccaaaataaggatttgcatataaaactcaaaattgcattgaatcgatataaagaagcatcgataagaaagagtgaaaataagtatactatgaattataactatagtagggggaatcaaaaagaagctacatgaaccagctaaaacaagcaaaaagtactgaatatttcattttgatatggaatgaaatagaaaatgtaactataataaaccttggattccatagttggggcctgcatcttaatcatctcaataaattctttctttatctgttgaaacctaacatctttctcctgcttcgcagacaaacccatactgatcatattttttaagttactctgtagcaggaagacattgaatgagaagataagtttcaattcaagcataaatggtaattaaaattacctatgtaacgataaatataaatataaattataaacaaagagaaaaatagttgcaaaaattcattgacagcataaacaataaataataggtgggaaattacctttttttgaattggattgtaaaagaacggagttcatggttgagtttgtttgatttttatactgaagaataacttctgaaatataattagagtccacttgacataaaattaattttgtagtgataggaatagagttgtttttgtttgggaaatcaccagcttctactgttagtgttagaagaaaaacatttattatgtaaagagtctatccattaccacaaattagggatttagattgatttttcgtatccatgattgattctttctaccctaatccatgattataaacaaagagcgtgggtatagaacatacgcaagttctactcaccaaggcaacaaagctttacttttcctaaatctatttctatataaaaatgtgaacttgagaaacttgatcaattacaattagtgcatgtttggttcaatttatttgaaggatcattacttatttttgcctgcttcatgagagagtttttaggaaataagctagtatttctcccaaaataatctatactgatcttgcacttagaatcaattcaggaaggccatctgtcactgtggagtcaccaaagtctaaagcaaacaggtccttcattcctgaaggaaaaccagtttttattaaaatggaagtgggcaaacaatcacttaaaaataagaatttcatagactcagacatggcttaggctagggtgggcaaccctcataggtctcccacggtgggagatgattttttcaccgttggatttattatcttttaaatcaaaggtctacatttttctttttcttttttataattgataattatctttcctggtttgcccttgacaccctcgccattttccactgcaaaatctccatttgcagtagcctcacttttcccatcagttcccccttcatccaacccaagatcccctctgccctgttatcgctctcctctccatgaccatctctccctaggctcccaccaccaccgcaatgcgaagcctccaatgctgttgcgctgtcctcgtctggtttcgcaacaactgcctcattactaccaacaacaagccctaccttcctccccgtctactgcttcaaccacgctaactacgctgagtctgcctccaacgctgccacacagccctggttgagtccgtctctgacctgcgccagagactctaggcacacagcttcaatctggtagtgtgcgtggggaagcctgagtcagtgctggtggacttggcgaaggccattgacactggttttctttattgtttatggtgggttgtgatttgttttggttttaggtaattgttttcggtcgtggtttgtaacggtagtttatggtggttgcagtagacattctgccatcctagggcggtttatggtagagatgtcgacagtggcttgtgtcatcgcagcagcggtgaagcaacaagatggagtgagagagaagggggcagggacagattgggaaaaaagaagaaaaaattgaatgctttattttagaagtaataaatctaatggtgaaaaaatcatctaccaccgtgggagacctatgaggattgtccaccctagcttgagccctcagacatatgacattgaaatcaccataaaaagggtaaaggaaaaaaaaaaggaagaaaagagaatcaatctttaagaaggtcacaaaagtaagtcactcagtcaaaccacaatgtgattaggtcacgaatgtattcaaagcctagaatatggtattgttaaatcataacctaatcactaaacaaactacaaattgtacaaaagttcaggatagtggactggacagaaagataggtgatttgagagatgcaataattagtttcaatttttaaattttgtataacttttgggttcaacaacaaaaaggcagcctagtgctatatagctcctgctaagcattggggattataaccggaaactgaaaaatacatactaaaggattatctgttatgtttatcaagcttaaatacctttagtgttctgagctgaatcagatgcccaagaatactcataagacggttaagtaactcctttgatactttcccttggcttgcctgctgcgacaaaaacatatagtcaatattacaatatgataatacaatgttcaaactgagaagaattttgagaaaaaaataatacaaaattgtgcatatatctagaagcatttagcataacaagaaaacaaaatttgccaataccgctaatctagcaactttagcaagtttcagctttatttctctaggcaatctccgtttgacaccctgaggtgtggaatcagcctcctggttttccatagttggtggccttgctgtaataatatttaaaataaaaacttagcattagcaacaaacttcccacattgcctataatgtgagcttcaaaacattttccaaacttacattctgcaactatcttctccaactctcgaatagctttctcaagtgttgtcgttttaggcctagcaatagaaccatctttcttgagcacattttcagatttctgcataagcttcaaacaagatcttgatcaacacagtatatgttaaacacataacagtccactttcacaacttttgttgtcagaagtcatagtaataagaacatgttatctcaccaagtgcacgctaaatggatagtatagtttgccaaaatcttaaagaaaaaccaaccatgtataccaatatcccttaaatagaaattattttgaatgaaaaaggatgacccgcaacagccaaggtaacaagtaaatggagtaaattgaagcaatatgctacactgttaagatccgatcacaaggtatgagacttaatcccacaataatagtccatagtggatggagtcacgggatcactcccaaaaacaatagtgggatgactgctatttttaatatatgtatatataaaatattttttattctttctattatattataatatttaattattacatttttatttacatatattttatttatatatatttatattattattattataataatctataatatatacactacctctgcccctaaatgagacatttttcaagttgtcttttacattttttataccacaatacccttaattgctttacaataaatgcaataaattaataagataaatttattctttctcttacaaggattggagaagactaggacacattaattaattaggtaaaaagtaattaagtggaaagagagatgatgagttaacataattttaagggtaattttgaaaaaataatacaaattgctaaacaaatttaatgttgctaaccaaattaacaaattttcttcaaagatgtgaattagttaaaaaagtcttatatttagggatgaaggtagtaatatataatatgcattatacatttgtctctattatatgatatattatgcattaatttttctatagtttttaaatattatagaatactttatcaaggtgagccctagcacaatggtaaagttgtgcattggtgaccagttggtcatggattcgaattcgaaaacaacctctttccatatacaagaataagattgcgtataatgaccctctcccctaccttcacatagcaaggagcctttgggcactggggtatgttagttttttagtttttattatagaataatttatagtataatatatgattaattataaaaataaaaataaaaggcaaaagaaaacctccacaattgtaggactgcttgggttggagagtagcccggtttagggtgcaaatacaacacccactcccacccaaaaacaaagtaagaaaccttggtgtactttagtttttattatagaataatttatagtaaaaataaaaataatgggcaaaagaaaacctcctcaattgtaagactgcttgggttggagagtagcccaatttagggtgcagatacaacacccactcccacccaaaaacaaagtaagaaatcttggctctcccactacaatagttagctttggtggtgtatttctcttaggattcttatcaattcgcattaaagcttttcaacgtgtctcttaattgcaaacgagcgatgtggatggtgatgacaacattgcagtatttgcttgggactagtcaaagaactagtgcatagccaacctgaatgggcatcggggttgccaagcatggtgagatgataggatccaattgcaaggtatgagacttgagtctcatgttggaagtatgggattctggttttgtgtttataagactttgagctctctaactacaacggctagtttttgtaatatgattttcccaaggttcttatcacacacttttcctggcacactgcatgtcatgcttcaatgtaacctgttaatcacaatggaagttgatctactagaagtgcttatttggtgggcagttccatgcttcatatggtagctatggtttagaatggagaatcctttactttaaagctgaatagcaagaatgaattgatataagtgcagcagcgagccttcttcaacatcaacagcacctttaacccaagttaattggggtcggtggtagatgaacccaatgatagatacgaggaagttaaaaaaaaaaaaaaggaagggggaggagaagataaaggggaaataagacaaaagaaaagaaaaataagataaaataaaagaagggtgaaagaaggaggggggaaacaaagagggtaagtactaaaaagggaccgtatagaacatagaaataaaataaagacaacagaaaagcagctacgtaaacttactggtgtttgtatagcagattttcccacggacaagttaagatctggcagttcattgatgccatttttatctttcgaccgaccagtcttttctagattgtcaacactatttgaggtttttccaggatgggatttggaatgtgcagatccacttttttcatggtacttctgatgagaagtatcaagcaagccacttccatctttatatttatcacatgtgttcttagattgaagtactttggtcttctgtttttcagcaccttctgcagcagcaggagcatcatcatttgatactttcgaacaaacaggaggatctgatgttggtctagtgtcagcagttttcctgttcaaactaattccagacacatctaactcactccgaaatttcatgtcttcataatgttcaccgggtacacccaaattatgggaggaactaattgtatttttcacaggtaatggtgcagtctttccagcagcagtcttgccaacttttacatgtttatttgatacatgactatcaatattttctccaggattcttcggtatatcttttcggcgtcttttctttgcttgctggataggcaatactggaggttcatttctggtaatatagaaagaagaaacagaaaatcaataaaatcaggaatttgtgtgaaaaaattatctactccaaactacaatttaatagattcaaaatgttggcacaacatgtgtaaacaggtgtcacatgaaagaatattcaatcataaaccaagaaaaaatgttatcaggaacaggaagaaagaacttcacaacatcaaatactaataaaggccttaagctataactgatgaaaagtttaagtcaaacaaagtgataggtacagaaaagtaaattcatagtttagaacaatagtgcaatagaccaacaatcagaaatgaaacaagaccaacatttcaagcataaaattaacaagttacaggaacactaatattagtctttgtcactactcaaactatgacagtgaatgatacatgatctcattacatgttcatataacaacacaagcatatatattccactgaaaatgtagtattatatccatcaactgaaaaagaggaaagtgcaaaggcttccaaaattaagtggtttacaaagaaaagagatagacataaagagcacaacctagtgcatgaggctcccacctaggggtgggcatataaactggttcgaaccaaactgtttccgaactgcactggttttttaaccaaaccagtttggttaaataaaactcaattgttttttttttcaaataagtttggttcgaaccaagctggttttaaagccagtttacaattggttcaaaaccaattcagtcctggaactagtttttgaaactagttcggttctgaaccagttttttaaaaccaatttggttctgaactcgttttaaaaatcacttctcaaatttggtttcaaaattgaaaccatttaaaccaatttggtttcaaattcggaatcggtttggtttggtttttttccctgaccagtttttgaacacccctactcccaccaaatgagatttgaggaaggaagatgcacacagacttggccccacaagtgaagaggctatttccaggattcaaactggtgacctccaggccaaaaggcagcagccttagtgttgaacaaaggctagccctcacaaagataagaaattgccatactccgaaaatattcaaacaaaaaacacttacatgcgttccaatttccccctatttacaaagaatccatcatgtttgattgcagaattatcaacctcaaaatactcattctgcagaaagaacagtagaactacataaaaaatatgcaaggtgaaacggcaacaatataggacaatacaattcctgtcatcattaatcaaaggtcaaatggtcataatgtcatgagtcatgacaaattaatatggtataaaaagataccaaccaattcagcatcatcaatgaaagagtcttctgtatcatactgatcatcaggaacatcaggtgcatcctcctcatcactgctgtccttaccctaaaaatgattcagagtcccattattcccaacatggaaaatagctcgaaaaatttaataaaatacttacatatgcatctatgatatgaatttatagtagaaaccaattcatttttgtacagaccattgagtaacaatctcaggaagcaacacacccataccatgtaaaggcgttcaatcttctctattacagcactgaaacggtttgtctgaggtgcatcctgttcttcaatctccttaggttgtccctaaaagtgacaagtgttattaaaatagtgaaaacaaaatcacatagtcacatactatttcgaaagacaatatgctaattcctgctggtatccagatgacaaataattatactgtagcataaaaccagatatagtcaattcaaggctcgattatgccatgccaaaaccagtgttgttttagcgctgacacaattatgccatgccaaaaccagtgttgttaactagcagccaaggcagaatggcaaggtagattttttaccaaccaccataggcaatttgtgaagaaaggcccgccataaggcacaatggtatgtttatggcggaatttcagacttctgccatctgccattgataacactggccaaaacacaaatacaaacagacagacattatatcaataggcataacgcattcaacctaataaatatgaagtcaaatacaagtacttccgcgagcatttcgactttggcacgacaaaaccctattaaatgattatccataagagcagcgccacgcagcacaaaccattgttgaaaaccaacaagaaacatcgtggcataacacgaatccaaattaagtcaataagcataacgcattcaacctaaataaacctaataaatttcaagtcaaatacaagtaattccacaaacaattcaactttgccacgacaaaaccttttcaaataatttcacgtaagatcactgccacggagcacaaaccgttgtcaaaaaccgacaagaaacacccgggcacttcccagttaacaacatgccaggtcaatcattaacattttagcagaacgtaattctaaaaaataacactatcctcattcctaacccttatttcagtccggaaaaaaaaaaaagaaaacacagtcacggctcagtcaaaaaccacctttgcaaattacaattcaaaatatcatccatacaccacagtaaccctctcacacattgcaacctacttaccgaatcacaatgtacgtaaacagaaatttcagaaacacactattactcgaaacaacaatttggaacctaaaaagaggctcaccggagcgattctggacacgagcgcagggttcgcattgggagcgcgatgctccggtgcggaagcggatccattgttgaccttgctggcgtccttcatgagcttcttccacgacactatggtggtctctcccgggcggagctccaccgtgaacattttccggtcgcctttcttcacgaacgaagacggagccctcgccgctgccgacgaggaatcgccgctgccgccgagaggagccacctcctctgcggccatcgattggcgagtttctcgggcgtcggtgcgaggtttcggggaaaaactgttagggcgcgagaaacttggcggaaagcgaaacgaataataataagccctagaaactgaaaaggaagaacagagaacgagaacgaaaagatgaaggagtgaagaggtgaattggaattgcgcggattcaaaaatgagagaaaggaagaaaagagagattttaagtttgagtgcaatttggactcggtcgtaaaaaactgtgttatatggtaattatttagcataagtggattgttgattgtacaattcataatacaagtttgaaaataatttacgtagcaccagttgtttttgttgttgttacgtagggtgtggaagtattctgagtagtagtactttatacttgttttttttatcttgtagcaagaggagatacagcgagtgacacctcctgtttggttgtcatactttttcatgattatatctataattgatgtaatcagttatatttaaaactaatgcaaaaaatatatataatcaatgtaaaaaatcagttataaatataacttgtgtaaaagaatgtgacgtcctatgtgacaaaacaacatgctatgtaaatattttcaaaactacaccaaactaggatgacaattactatgatttagataggttcccataaaactatacacataatcttatttagatataatatctatatccggtctcatattgctccaggtaacaattttaatcatcatttttatacctgcatgatacttatatactcatatttacatttgtgatatacactttacttatatataatatataaggttaataataataaaatcaataaaaatttaattaaaatatttactataattatattaaaattcattattaaataattcaaacataaatatgcacataatattaaaaaaaaaaaacataatattggtttattcaaacttaagtcataaataaataaaaatacaaaaataatcatccatcttagataatcatccagcttaatgatttaggattttttggctacgtgccactataacagtataactatacgcttattcgttcattttttaataggctcgaaataatgataaactagatcttatataaacctgtctagaacatatgaacaaaaatgggaccctacataaaggatgacatgtttactaaaatatccatccactcactcccaaacataagcatatcccaatatcccaagcacaacacagtgacacacatgaacaatatgaggtgcctccacctccaaccttcactgcttccttttcctttgcatgcaaaactcaaaccgcagttacatcatatgagccacactaccaaactattttggcttactactcaccaacctccacgtggccagcacttaccttcagcaagtccactaagtaccaaggcacttccacatttactggttgttgccccagcccaatccggtgacttgtccaccttgcttccaataaggttcaatctctttctttccctttttcattgcttggagaaaagttacttactaatattaccatgtctaaaaaaattattcaataaatttgggagttagaaaagagggtatactaaaaaaaaatgtattgcgagcattcctcctatttatttgatagttcatgattattataattgaatttgacactaggcttaggcttataacaaccttttactccaaaatggagttagtgtgatcttttaagtctagaagttaactaaagatttctttatatattgcagtgctgtgcttctatcggcatacttcatagcaaattttgtcgtgccaggtttccttaccaactctttcggatatgataagccatcaaacgaagagcagaaggttgacgatgtaaatgcaatagaagatgaatagatagtcaagggaggtcacgaaggaagaaacaggattacgtaaatgtgagaactgagctcatgatggttgaagcactactgtacgtgtcttttgtatctttagttcgcatttagattataataaaaacatccaagtgagatttcttttgctcattaatattaggtattctagacttggtagcgattacaatctcatgaaaccaaattgttcctgcccttgatttactggggttactactacccccaaaaaaatgttagtaaacctcttaagagtacagtctttatttaacataggattaatatgattattgtttgatatttaagaatacaagttatttgtactaaagaaatttgccatcaatgattatgtttatgttaatgttagtatagaaatacttgcaagtgcatcatgatcataccattaacgtaaagagttgtatgattcatgaaacatttgttatgacaatattcccccccccccccccccctattatctctcttcccttcctaactttttccaacaatattcatgtccaaatacaatttctcaaacataaattcactgtgttatacttttatattaatagatcaaattctgttagatagagactaaactacccaaaagcaagcattactataattttttttataattacaagcattactattatatatctattaggatatattttttaatgtctttttttttaattattataattattattttttaccgagaacttaatgtcaaccatgaccgaattcctacagagttgcaagcttgaggagtatctcaaaggatctccaacacccgagcagatagcaagtattggcacagagtgaacacataaaatgtttactaaaggcccgaaagctatattttcaattccctcaaataaaaaagaatgaagtattaattaaaatttctacagaatacaaccactaagtatttggcaaaagaatagagaaaatttacagttatctgcagggggaggaggaacccaaaaacattgcttatcctcaataaacacagtggaagatgaaatttgtctaaacaactgcccaaccagcatcgatagaagatttctcagaaggagatggggatccagacttgggaggcttctttccaaacaaagatgacttgctgtcaaagaaactagagaatgattgccgacctgacttttcttcgtcgtttgtctgatcttttgagacagacttcctcaatagtttatctttgcctccaaagataaggctaagcctcctaaatgggctccttggttcaccagtaaccgtagttgcttcctctgtctgcttaatcatttttagagcttcttcgggattcaataacattttctccactgtttcatatacctacacaggaatacgaacattaaattctctattgaatgatgttattaacaattagttgcagatataaatcaacaaccaagagttttattatcaatttacatttccaggggaatgatttttcatccccatgcttaagaagtagggttatcttgcacaacgagcttgtatgttttttttattttttaaaaaaagaaaacagcaaactgaatagttctggaaggtaggctaggtaaaagttacaaatttcacgcattgtgatagtcttggagtgttcctttttcttcaggactctgctttgtgagtttatttatacagtgaatgactgttcaaatacgaggataaagcaataaatttctccactggattacatgtcatattgaccatgtatttcatggtattaatcaatagagaggcttcacaaggattcagggagatgctatataacttcataagtcacttagtctaggagtacccacctggacgagaccatcaactttctcattcaatttgttgttttgacaagcattagttatgtactccttgcagtcatagaataacttcgagaagtcactgttactagacagcataggttcggcaattgcaaatcctaaaccaagctatataattaaaaccaaaggttatgattagaaaggtatagaaatggtataagcatcaatacatatcaatcaaatcgagtcaacttatacgaagatgaaggaacaggttgagtttttatcaagaaactttacaaaattacaggattatataataggatcatttatcaattaagcaacattttggaacaaaatactttatgtaatttaaaaattctgaaataatataaagttaagaataattatatttcttttcaataaaaattggtaagagcaaatgctttaatcttcacaaaaattaacagcaatgccactgaagtctgtatggaaaggagttttactaaatgcttgttttacattttttattaggaaaaaaggacaaagatgtttaaaaaagtatttagttgacagtacacatcctccagtgaaggctatcaattttcttgaatgacacaggatattactattagtcctatgtaacaggaagaacatcccccatccttacaacaacaaaagccttatccccccttcttcaacagaaaaatattaaaagtaatacatttcatctcctttatacaggcagatgataagtatgtttgcacagtttccatttttttacttccctttctcaagaccaaaatttttgatctaggacacccataaccagacattacattgaagatttgaatactccagtttgagccaggttaaaacacaaaagttgaagaatttatactaacaaatgctttattggtggttggagccagctcaaaacacacaaattgaattacttttagactaacaaatgctttacaagtgttataaatattttttaaataattaacattgatacagattatggataatgaagggcatttttatcagttaagggcagatattttggataaattatgcacttaatgctattggaaatttcataaaaagcatattatgcagttttaaactcttcctggtctactatcaatgctcatttcatttttaactgtatactgattatggattaatgggaatgcccttaacagataaaaatgcccttcatgatccataatccataaggttattgtctacaaatgcccttctctaccatacacacacataacatgttgctgcctacagtcctgaaatccagcatgtgaaactgcaagtgtgcatgtgttaaagaataaccctatgctacctagagtcctttgaaatccagcatacgtaacatgttgctgcattgtatattagagctctagggagattttgggaatggacatgtggaggcgaccaattgccttatatgttcgtataaaattctttcaaccaccagcatagataacaagttgccttatactagagctctaggcaggttttgttaagggatgtgtggacatgcccaaccggcatgccaatctaataattctaaactcgcaaaaaatgcctagagcctagatgtcaatacatttttctcctatgatatgcattacaggaaaatagtttagttcttgattggtaccttcatcttcatgattcaagtctattactatatattctacaatctgctttagattcagccaccaaactccaaaaaataagaaaatacaattttcaaataaaaaattaattaatatacatcacttatgagttataatattaatgcttcagagatccattatgtaatgacaaatgacaactgtctatacacaacaaaattaatcaatgtgataaaagataaaataaagaacttactaaagaaacaaacagctgtccaaaaagatcatatggatggatgtcttcaaatgcattgaggatgccctccctataaatgaatgcaacaagggattcaagggatggctttagggttgaaatatataaattaatgcaaaaaatcttcatcaccaacttacactgccaaatcctcatcaaactgaggtgcctgcttaacagcaggtactggtttggatgtttcccacaattcacgccataaattacctacaaatcagatatgtttaataatatgaaagcagaagaaagtaaatgctcgacagttcccgtatttcttgcagattttgtgtgttataacttattataacttataataaagtaagacagtactcaagatttacttatctccatatgctttaccatagatgtgatatgatatccaatttaggtaatatatcttacatagatgctacaaagattgaggaatagggtttcaacactttcaattccatggtttgcccaaggcaattaggaatatgaaatctgaatatctatgctgatatcaattgactgacaatgaaattattaattcaacattcaaaattattcaaactctacatttagacattctggacccaaaactgatcagtttgccacaaaagttcctacattagactgcaataaacaattcccatcatacatagtgtagttcagtagttccatgcatatcttcctcacaacttaccaaatcacaacctctttggaaatcaaagccataaagaacacataaatgatggtaaaatttataagcatagagcaaaagtttactacaatcgatgacaagttacagtgaataattgtttcaagcaaagtaaatccacaattttatcagatgttgatggtccatttacgtagaaaaataccacaaaatagccttgcaggagaatttaagtacatcaatctatgatggaaaagactgaaagtacaccttctttttgcattcgccgacttagctgacctctggcagacaatgcctcaccactatcaaaaacatcactatcctctgtacttgcttcattatctgtccaatcaggaggagagtgccatcttacaaaatcctccaaaatacatccaggatttgcagcctaaaatatgataacaaacaaaactaactcagacagaacattaggcacattcaacatagtaagaagcattcacaatatcagtaagaaaagttcccttcaagggagctccttaccttgaaagcctgcatatctgagagcagttgagagcacccagcaccaacactgaccatgaaaggtaactttgtaataagaaaatgcctaaatgatgataactttaagctattacataattgatgcacatctgtaattaaagaaagctagcatttacaaattatttacataagaaacagatatgatcataaatgtattacaaaatagcattctgtgaatgtttgttgatcaactagttcatcaatgcaaattctagaaattagtaaaaaaaaaaaaaaaaagaccaaagacataggtcataggttcagaatccagactcagaccctggtcgtgggagttcatagtctagatgtgagtcaataggtcataatcataggtttagatcatgcgaaacaattaaaaaaggcatacaggaacacatctaacaagcaatgaagagcccaagaagcaagatgaccttgattattttaataaagaagttcattatatgaaagagtcaattgggattcacacgctatatatagggaaaacagaaagtccatttagatttaagataacagattgcatcatggatgaatctcagttagcatacagacctccctgtccgcagcacaaactcctctgtttccctgattagatcttctgtaagcaaaggtccttcctacatgaaatggtcccaaagttctcaagtataagagtaattttaaatagtgattatatagaaaaaaaatatatttatcaaacctgagtgattggagaatacacaggctcgccagtttccaacaatgtcatatctccagcaggatgatctgcaccaattcgaagaacaagctccccactattcaatctagcatatagaacagggcttgcaggagctctggcactacaatcagtcgattcttttatgtctgaattagcttgcatcatcatagagtctaaagattcagtggcaataatacggaaccttttccgagagatgcagcaattgattacttgaaattgttgatatagaagacatgacttcagatcaggaatctcattctgggggactcctggtaagtattgttcctcaaaccaaagtttccttagctgtatcagtaaaataactaatcaagtttaaaatattcttcttcagctggtaattaaggaaaagtaggattagtgattctagttaagttcaagttacagatcctaaaccagaagaagtttgtatatgatttttttttttcttttatagacaaacagatttgaggaggaaaagaaaggcaaacaactttacagtgcacgagggattctgttgttttggtttgaaagccttcaaagtttccaataacacagcatatgaataatttgcttccttttccacaaattttattttgcaaaggggaagggaaggataaaattggatgcaaactttaatagaccagaatttaaaaaaagaaaagaaaaaagaagcagcataaaacaaggaaaaaaaattcactacccaactgctcaaacaaaatgaggttctcaaacctttaaaataactattaaaaatcaaaacaagtaggaaacaaaatttgacatttatcaacatggcatcatcaagttatcttgcatatttatttggccaaatcacgtgatctaagatgaagatgtcaatgatgatgatgcactctattactaagatcataatcacttaaactgacagttacttcagataatagtttatatataatggaaaaattgatcaataatgtaaattaaatctagagttctgggtaagtaataagatgtatgattatgatatcagaactataagttcttttgaagttaaacatacttcagcaacaaccccacaccagaaaagagccatttttcgaagagtcttgtagtttccaaggatttcagctagcttaacaacaaggctttcgggaggcgcaccatgaatatctcttggcaaagatgtcatagcactttcctctagattcgagtcgatctttcttctaaggaaatctccttctgcgaatatcttgcaaatattacaacgaaagtgaaagatcataacagataatgggttaaggaaaatgaggacaagcattaaaacgttctttaacataattacattatcagcaagccacctacaattcacatacctggatcaaacagagaattaattaattgcacaactttcttattgctagtaaactcagatgtaagtttgtcctccttttcacgtagcactaaagccttaactgccaagagacttaagcctgccctctctctagcaggtgaagatcctcctgatgaagctataaaatctttcattgactttgctttacttccagccctagtcaagaggtaaaaaaaatttaaggaagaggctagatatattgttgagcagcaatctttctgaatgatagaacaagactcttatgttgttgaactataaaaacttgcatttgacaaatatgtgctgtgccaaatagagaaggggaactttgcaaccagagaaatagaatgcaacatcattgagtagaacctttcagtagttcacaaaaagcggcaggaaaacgggacaacagaatgcaaaaatatatgcaaaacaattacaacttactcaacagctatagccaattgctttagcacagatgatggaggaatggggtctttagttgcagcagttaggccttcaactgagggaattgcttctgaagcctgaatcaaagtttttactcatacatcattaaagcaacccatatgtgtaattgaattggcaaatcaataagatactcatttatataattgataggcaaatcaataagaaatctcaattgtatcttcaaagattttactggaaagagggacaccatgagatacctaataagcatgcattaccaatttatcacaagcataccaagcattgctaacttactagacaaaggatgatgacacaatctgacagactattttgaaaacaaaatgctcatagtcagcatacattatcagcttttgctaacatcctcctcacttaacttcctggtttagagacttcaatcatacgcacacagttggaagatgaatccttgagttaaaatgtttcagattttcttaccttggcctcgagatcattctttacattcaggaggtacaaattatcatcataaaatggaatggccatgcttgcatccccaactttatctgtatcttcaacttcttttctccctctccggatgttctttattttatcttgccaatcctgctttattcctaaatgtggaggcctccactttatatgcttcgattcactatgaagctgcaccatcccattacaaagaccaattgtgtaagtaattacaggacaaatgtcacgtaataaatacctagacataaacgcaaacaaaaacatataaacagttttcgatcatctttaagccaagactcatttcgaaattataactattcactttgcaggactcctgcaaatattttcacaattaattgtgattttttttttttttgaggaagtcattgagggaacgaatccaataagaaaccaaacaatgaatttcaacaccctgatctaaatttcccttcccttattaacgtcaaattagaaactcacgaaacaaatatacttttgtttgataatcaaatacagctcccggaagtgcatatacgttgggaataaaaacaaaaacaaaaatgcaacaaaacaaaacaaaaacaaatcgaacctcggtaggattgaaatagttaaattcaatgtgtcctcttccaaatcaataattgccattaccttggagtcgttttcgtcggtgtgaggagattcagcttctggttgttggccagtgaaggtgttgggcgacgactgcttatcgtgatcttcttcacggtcaacaaattgagtcaatgctaattccgaaaacaataataataataataattatttttattttattttataaatttattttttgtttgaatctccctaaaagagaaagggagaagaaaaaaaaacaaaaaaaatgcacatccgttcggaatataaggagaaaaaggaaaaccaaaaatagagagatagtgattgatgtggcgcgaggagaacctcgatcggatttgaaatccaagagaacgcgctccgctttggccgcggcggaatgaaaggcggttctcgctttggacacaaaagtgtgctgctcctcctccatttcctgcgcacgttaagccacaacacgcgaagatgaggtcaggattgaaacgctgagactcatgccatgccaagactagatggactggaactggaagaagaccaacacggtttcataattgatatcaactagtataagtagtagcggaacatcacaaattcactctcctctgcactcaaataacccaaaccaaaacggggatcgaagtaataatattggtccgttccgttatatactacgagtccgtggcaattgccaactgcattaaatcactctgcccggtcttttaagggtggatttagtagagaaaatgaaaaaaaataaattagtaaattagtatgaattttagacctttattactttttcttcttctttcctttctactaaacccatcctaaattcgttttctcgaaatgcatgccggtctgtcctttcctgcagtccaaacttgtgctaccatacatgataaagaaaaaacaaaacaagcattcacggttgagtagaatggattagattgtctgtatttgggcaataaaattgattttgaatttatatgtttaatgtttaaatatttttattataagatcaatttattatgagtaaaatttaatataaaattttgggtcaaatataaattttgaaaataatccatatattatcacttttaataatgtatcatatatataagggatagtctttatacaccaacccaaaatctaatacatcattcaaaaattttaaatgccaaaagtatccttgtgttaaggttcttacggattcatcgattcgtaagtaagtttttcttttaaaaaaagttaaaatatatatttttaaataataacacatgcaactcttgaacttacaacctccatgttattaatacgatattccaaccaactaagctaataaatcaattatgtttaaaaataattattgttgtttatattaattatccaaccaaccccgtcatgcaggatccctattccaaaaaaattacataattattcttatattaatttttattttatattctaaatattaaaatattaaaggttgattttatattttacttatattagaatttaaaattaatgttttaaattgttggtgagacatttgaagtttttttttttaaaatttacttgtatcaaaatttaaaattaatattttttttaaaattttggagcagactacgaggaccagggtgaacgaacgaacatagtgacagtggaaaaagattgcccatgacgaggatcggggacggagacttaggctttgtttgagagttaggaggggaagagaaagaaagagatttaaggggaagtgagaggaaggaaaaggaggaaaatgagagaaatttttttctccttatttgggagttaaaaatatattaagagagggaaattcagagttaataagatatttttacaattttactcttacttcaaaaattaatacactctatattttacaaataaaacttaattttaaaatgactgaatgataataataattttattatttttccttctaaaaatttcaaattgggagaataacaatttttaagctttggaagttttcagaggagttttaaaaatcttcaaatctttttcctcaaaaattaaaactctcaaagaaaaaaatgtcatcacttaaatcttttatttttttctcttcccttttaaaatccatctctcaaacaaagtctcaaattaattggaggacggggatgagcagcgggggagtagtcacccgccttgccccattaacgtctctagttatcctcacatcagtcattattgaagtgacttgtaaaaagattatttaaaaaaaaaaaaattgtgaaaaacaacactaacatacagttatggaaggtttgtataatttggatgagattgtaagttgaaatcttgtcatcataaaaaaccagaaagacaaaaatcaatgaagccatatgtataacaaaaacagagaatgaacagtgacaaaggcagggaacataatagacaaggacagtgaaaacagtgagggaacgcagggaacatagtaaacaaaaacagggaatagagaacagtgacaaaggcaaaacctgagactgggaaaatcagagagatgaacatgcagagcctgaggtgaaagtccagtcgccagcaagttgctgaagaaggaaccgtaaattgccagaggaaaccgccggaagatgctgggctttttagatatcccttttctgatttctcggagacaacaaaagtgtcctttacaaaacgccctggaccaccatgttgatgttgtcatgatcctgcagccaccatttgccaccacaaggaatcctcaactccaagtgtcccacacagtgatttgctggatttctgccacgccttggcagggtggcactgccctgctgccattgtggctgtttaacaacacttattcatatttattttttcattgcaatttgtttttggaatgttaaacaatactggatattttattattgcacaatgcatatctttctactgtaggatatttaatgtgtatctttggagaaaaacccgatgaaaccactctggagcaacttgtagattgggaatacacagtatgttgccgtttgcacttggtcaagtgatttacataattaatgttatattctgatggtagtcatttcaattacagttttgtgatacagatggagagacaaaaaaaatacttttatagaacgccaaagacacgagaattggacagtctgctgggagatatccaccataaaattctaggtattttaagcatacatttgatagttccctattgttatttatttatttactttgaagtaagtagctgagcctttgcccagacttgtaacatgctctaaccttgaaatggaaaaactccacttaaaatccagttgaatgccaatccatgactttggtttagtcatgttgaggtacattggaaagcgggataatggagaaacaggcacactctataaagatgcaatattacgtgtagagttgtaagaaattagagtttaataaaaaaatatgaaattccttgacacagcttatgtgttataagagctatgtgatgtaggtagttattttcttcctaaattcaaattataacacttggtctctggtgcaaatcttacttatttgcgaattcttttattcaagatatggagagggcgatcaccagagacttgttttcacgtatatttttgttccaaacccatttgataaaggtggcaacttttgcagctgaactggactggtaagataaattttgtcattataataactggtgcttgctcagacatttttttatcattgataattttatttcagctttttgtcaatggccactgattttttattcaacggctacaagatctacaattccgtgagcttgggcttctgttgctgacataaaaacatccctttccatgtcttcggatataacccataaaggtttgccttgagtcgggcggaaaaaaaaggggggtatgttgactgaagaaaatttgcttgatataaaaaatggaaggttcaaaccatcaagtttataagaacctcttggaaatggagaatcattgatatggttaatgataaaaactggttttgtttggaggcatgttttgcaggaaatgactgtagacacatttattcctaatgacactaagattcttcatgatggtaaatagatgtagacatacataactgataattgctaacttatatcattgaaatccattttgatgacattatattgttattaatccctgttccgttgttctttacattaggaagaattaatatcatcactggtcctaatttttctggaaaaagtatctatctaaagcaggtcagttattagttctttatctttctggtatatgtattctgtatgattttgatcatactgttttaaatagcaattatgttgaaaaggtcattctatgacattaccttctagtctccaaaaagaatgtttctaaattctagtctctaaatgaaaaaagtgttgcagaactattctttagcagtacgtgtaccacgttatcaacttctggttgttaatattcatctggtctgacaacctacaaactacaattgataatatttatctggtctgtcttgatttgggttttgcatgtttttattttttgatattcactcgtaacaattttttctgttatccaattgaaaaagaatttaattaccatgtatttttgggataaaaattactttatattattattatttaataacatattattatattatttgataaatacaagaatatatcaaatttactacatgacaattggcatcacaatttaataataatataaatttattgtactcaatattaaagtaaacaatttttaatatttcttatattatcttgtttttgtatgattacctgacggtaaaatgacagactataaataaattaaaaatcttaacatttttattgttttatgtgatgagctcttgtttatccacctttccagcgcaaaggatttttgtgagggactgtcttgaagactaaaaattattaacttccacattaaagttcatcagattgttgattccttaacatacagtctaatgtgtggctattacatgatgctacaaccttgctccttgttgctctatgatcataatgtaatgagaagtattttgcaggttgctataattgtttttctctcccacattggcagttttgtgccagctgatgcagcaactgtgggtctgacagataggtatcattttcttatgaatcgtgtcctttgtgaaatgggagttacattgttgtatgctgatcttagttttacaattgtaattttttttttcctttggtggggaggggggaatattttctgcaacaggaagccggcttatgacagctgaacaatcaacatttatgattgatctacatcaaatagggatgatgctcaggtataccaagataaaggcaaataaggatatcttcaatacattgactatatatcgatcataggcaaaatctgtataatctcccagtatttggactatcatgcaggatgctcctgtcttccatattactcacttatttggtttaattaatcatttggtctctatatccatgccaacctttcgtttaagtccctatacctaaaaactttacatttagtccctatacaaggaatttttttaagttttagtcttatgcctccattttgtgacggttttacactaccagaaaacgaacaacatgaattaaaacataaaaaacttgttcgaatagggactaaaacagagaattttttatacggacaatttttaggtagagactaaaatgaaaagttgatgcatgtataaagatcaaataattaattaaacccacttgttttataattgcagatgtttttctgaatggttttatctgaacaattaaatagatgtagggttccaggagatttgtagtttattaaaagaagagtgtgtgtataactgtatatgtgtgtgtgtgtgggttgggtgtgttaattttttcttttaatgttgaggaaacctgcaggcatgctacttcacgttctctgtgtctggtggatgaatttggtaaaggcactcttacagaaggtctgttaatccaatgtttattaagtgtctaaatcataaatacatggaatgtgtgtgtactgcagatgctagtttttaccataaatgttttgatcttcctttgaaaatgatgtgtgtggtttttggaatcctgcagggctgcactgtgcactgcttgctggtaatttacaaaactgctgtttaaaaatgaaaagagtacactacgcatattgttctttctttccttttagctgataacaaaaatgtataaagcatattttatgttctgctcttatttattttattagaacaagctgtacggttcatgcaggtgtaccagaggaaatcataaaaagagcaacagctgtgttggataccgtttcaaataataaacatgttgagcggttatgcaatgagaacatctctgcttaagatcgtcaatacaaggtgtcatatcaattttcaagaaccaaattacagctttggatattgtttactctctcagagacatgttaaattatatttctgaatggaatgcaggatgccatggagaaattgttggaatatgatattgacaaaggcgacttaaaacttttctttgaggatgtattttctctagttcttaatgcatcgtgactgaactgaagtcttctgctggttgttttcgtaggaattattgagatgccatatgtgatcatgacatttatgtcaagacgagttgaatccatgttttattttaagtcttttacaaacttaaggtccattttggtaaatagtttaattagagacttacagaataatatttattatgtataagttgtttttatattgaagagaaaattaagttgaagttcatttcatattattttgaagaatttattgaaataaaaaaataaaaagaacttatgaacatatcataataagttcaaataaatttaaaataagtttcttgtaagtggttctttatattgctaaattatcaagcatcctagttactattagtttcctcgaagatttctctttgcatactgacccaaccgttgcgacatctactttagggtggataccacctgggttaggttggatcaaagttaatgttgatgctgctgttagaatgtctgataacgaggctgtttgcggaggagttctgcgtgatcattatggtgtctttttgcatggttttatggcaaacattggaacttgttatgtcctagaagccaaactttgggctatcctcaatggccttcagctagctttggatagaggttactcgcacgtcttagtggaatcagatgcggctgaacctgttcgtctctgctctactttgtctcttattagagcctgtttggatacaaggttagaagtaattttgagagtttttctactgaaaaaaacactatatttccattagagaagttcttaaaaacacttctaacttgtatccaaacagacccttggtcatcctcttctcgagagagtgcaaaccattcagaggatgtccagaattcccgtgggttgctgtttcagaagcgtgtttagagaacacaaccgggttgctgatgagatggctaagagagttttctctcttcagctttgttttctgcttttaatgttgctcctgcgtttatttcctctttgctgcgtgttgatgcagctggtctgtctgttccttagtttctgctttcttgggctttagccccttttatccagcaaaaaaataaatatattatcaagcaactttaaaatgatttaaacattaactcgtttttctcagctaaaaatccacaattaattgttgcccttgctcataatattttttagaaaattctaataattttgattattaatatgttttaccaccgtttctctttcctttccttctttcggtttgtcacagcttggattcacatcaactcttgaccttgaatcagttggatcttgtcaccttatcaacataagttatcagttatcactatagctacttggtcagataacataaatgatagtgttgttgatcatttcatcggtgcaattaaacgagtaataaaaaacaacaactttcttacacgaatgcatcttgtcatggatacaccttcatctcatgttatgccaaattgccaatcttagtatatatcatctacttcaagtaaaataatacacttggctagccagtgatcacttttcatgaagcctaaatagattactctacggggtaacaaatctagtagtatttttttcgtcccaacaccacacacttggcatttgatattgagttagataaaaaaaatgtcattgaagggataaaatcaatcgtcaacttcagttaggcagctactagctgtctcatattaatgggagatgtgtaagttgaagggccatcaaaaagtttattaacaaatagacgagcagctgcctccgtaggatggaattggtcaaagaagatgtgatcttgtctgttaggacaaaggtttgacaatggcaggcagggagctctggcattcagctctcccagtccacaacaagcaccttttacctcactaaatcctgaaagtgatttaaacttattttaattagaatccaactttataaaaacaaaagagtaaatagccaatttatttcctgaatttctatcttactatcattttagtcttgaaattaagaaaaacttaaataagtctttgaaataaacctatttttttttcttttcattttggtctctagtatgggtaacttaagtgatactactaataacaacataattttagaaacaaaaatgagaattttttttttagagacccaagtgaaacattaaaaacactcacgaacttatttgagtttttctttacttttaggattaaaactataacgaaatgcaaatttagagaataaatattggtcatttactcaaaacaaaactaataaacatggtttggtagaggaaagaaatatggaagaaagaaataaaagagaaaaaaagtgaataaatttttaagttgtttgaattaaaaggataaaaaaataaaagagaaggaagtttcttaataaagaaacgaaaagaaagaaaataatatttggatatgttattgtataaaaatagtaccgtaggaagctggagtctgaataaggtcgttgatggcagcaaaagtgtcaaaataggagtagattatgcttccattctccgattgccattccttcaacatggactgaaggccttcattatattttaccgccatgtcattggcttctataaagcattccgttttgttcttcagcctgaaatcagggcagcatccaagtgtcccaactcccgcaatctcaaatttgcgagcaccatgatcgtataatcgctgcaaaaaaaataaaaaataaaaaataaaaaaagttaccgaaaaaaaagaagacaaagtaaatgacacacgagttgaccctctaagcacaatagaacatttacgagaaagtaacatgcatgcaaatagggtgcatgtattggaaccccggcccgcaatataattattaagtcaacggtacaatttttttgaagtttgatgtgatgggtaggtaaaagtaaagcaagtctatctattgatcagtgattaatgaagatttgtagcatagtaacttgattataatcatgttcatgtgatgttatgtgttacctgtagttgcacttttagtgagaaagccatggaatccacatactgttgcggggtgcttttcttacgaagatccgatgattcaaagtatccaaatatatcattgctgccaatcaccacaacgaagattgattttgagagatgcttctgtagaccagctgctcctcctacttctcgagtcatttcctcatgcacaattgagtagtagtccacttgtttcctcaacggtattgattgtctcttaaatgatatataataatatatattgttattaagtacactattatgccaacaatatatagaataaggggtggctcagttgggagagtaacgatttttatggaacattatatatagagagggaattcacttaatttaagagtagaattacttttctgttgattttcttaaaatctaataattaagattatgaataatgaaaataaagaataactctaaaagagttagttttaaagtaagtgaattcctcctttatatatatatatatatatatatatatatatataatatgatgagtaataataaaggtataccttaatttggggtttattagagccaaaaaagaaaaagaaaaaaaaaatagaaagggtagatagagaaaataataattacaataaataattaatgaataaagaaaataggattaaaatgatataaagaagaaagtgaatatatatgatcattcatttttaataatgtgcctaaggggcttttggtagatgaaaaatatttatttttgaaggaatcttaaagtgacaaattgtgatttttatgtttggaatgtaattaataaaaaagtttgtcaagaaattatgatttctgaaaatcaattttaactcattttttcgcaaaaaacattcccaatgaggggtaggaatacaactaatttcttgattagaggaaaacttttaattacttattttacatgaatctttaattttcaggaaacatattaaaactaactaaacgtattttacacatttctaagaattatgattcctagcaatcgactttcctaaaaattatgtaccacccgttgggttggattagttatgcatgtgacctggtgtgtttcaatctgactcggcatgacttgttctcgaatcagtgactcgaacttgacgtgtcatgcatattttagttttttttcccaatcgaacaacatcacttatattagaaaatttaatttataccttacatttgtattatttataaatttgcttatatttttttaccaagcataaccgcatgttaaaatttgagtgataaaattattaccatttttaaattttccttgactaatttgtgtgtattaaattctaatttaaggttgtttatatatattgaattatgaaaaaaatatgttacatgctcaaaattttaaataaattcataactatatttttaaatataataaattttattaaattttaaatcttaaatgtacaagcttacatgttatgaaattattttaatttttttaaaatataaatcggatcatgcaagtaaacagataactcattagatcaatatctaacttagtaactaaatatcgaatgagttaataattagtccgaatctaataacattggttgagaggtgatccaaaacatccaggctcatcttgggtcagattcctatatccctatttaatttggcccatatattgcataaacagaataaataaataaataaatttaaaaaaagcctggaggtaataaaaaattaaagggaaagagggaactacatttggtcacttacataacgttcgtctgtaccatcaaatattccagcacctgcagaggcaaagctaacaccatccatgaacgatgcattgtttttgttggcctttgatgttataagggacaggtaaggtggtgaagttggcaaacccaatttctcagctgcaacccacacaatcattctattaaaaaatgtctctatattctatacaactgtttgaagtggcatattaatagctagagtgaatttggattcacttaccaacaaaatctgcagcattcttgccgttgctaaatctcccagttggtttgtgtgtaggaaaatcaacaccatagtgacgatgatttgccttagcaatggaaagagtcaagtaattgttgttgcccacgtcaacaagtgagtctccaaacacataaacggcagaaaccatttcagcctttgaggaaccaaagctgaataagacgaagaaggcatggacaataaggaaagctcttttacccatcttggtgggtttgtttgtgtgtgctccaaattgtttttggtttagggtgtctttggaggtagacaactgttagatgattgatatttaaagataccacaaagctggatgaaaggtacacgttacgtgtgaaaagataaatttgattgaatgctagtgagagatagtggagcaaagagtattttccagatactccatccacttattttattgtcaatatgatgtgtcatatgttaatgggacaaacattgtcaacatcaaaagtaaaattcttaaacttgttgccttggtttttagtgttaattccctcaacaactaaactgtgacaaagttaagtaggcctgtttttgataattacccaactagctaggcacaactctaactcttaattaaatttagttagtttaatttataattaatctgatcgatgttgctgattaatgaaccttcgaaggcacagatcaatacatcatacatgcatcacgtggcaccctatatctaattgaatgaccaaaaaaacatttttagtggtagatcttaaattaggattttagaccactttttagtggaccctatagtaccacataggattatagatttctcaaaatttctctaattttttcctttaatggtagatctcattttgagatcttagggagagagaaagagagagaaaatttattcttttttgaacaatgtgcagatcttgagggatcttttacaagaactcattctccatgttggagatctctccatttcctttattgggagatcttgtgaagatcagatcttgagtttaagatctttacttaagatctaccactaaagatgctctgatgaacttcgaaaataattactatatagtatatgttgctcaactgttctttatgatttaataaagtagatgggttgtatataaagctagcagaggtagccacatcaaaatacgcaacatccgacaagtaaaagcctcattcagctcaaagtaaaaggttctatatatatatatatatatatatatatatatatatatatatatacacttttatataaataattaatgctttgaacttaaagcttttaaagctaggtcaaaccctcatgttcataaagtgtacagtagtacacgtttaaggtccacagtggtccccccaatattttggctttgaaagcactgctgaatatatattacataagaatttcaatttttcatgatcacacaataccaccttgacccaatggaagtcagcttgtaacatatatgcttcatcccactataaatcactccccaaattcaatccggcattcatgcatatatataaattttgatgagctaaaatagacttgtgattcgaattcattgcacttttgccgccccatatattctttccacttctctatgttcatatcatgattttgttactatagtagaaattctaaggaaacgaggagcttaataaagttcctttcattccaattcatctttgtgtggcatttgataaaagacactgaagacagttttctgaacccaaatctttttaagccagaacttcgacaatatcagaatctttggttggattaataaaatttaatagatacagaaaaatatattgaaataagtaactttattaaaaattattcttaaaataatttgatctatcttgaaatgtgtgtatatgtgcgtgcatgtgagagataatttaatttatgtaaacatctatttctaactaatatggtttaatcattttcctacgtcataagtcttatgatgtaacaataaaatcaatattcaatagatgccagtgtaaaaataacaatatataaattaaaccctctcactctgtgtatatattccacagacctccattccatgatccctttacaatttaaggagagaaaaaaaacaccattctctgacattcaaggggaaaaaatatagtaagtgatatgtgatttattcgtcttcacatgttgtaaatccgttcaaataaaatattacattttaggagcttcactaacaatttgacagagaaataattaatatttattggacgcaaaaggactagcatttagcaagaagggtacaatattcacacatagacacactttttaaagcttttttttttttggtccaaatagaaactattgcttattttcttaaaaatatttaattatgtgcaacttttaaaaaaattattcaattgaaaatatttaaggaaacacaaacaaacagtgcattgagttcgtgaaaagaatcgatagggcaacccatcataatgttccacaaccacacaagagaccatgaccgtcccgacgtacgcatttacggtggctccgctcaagttacgttttgttttcagactctttcaagttttcaacgtcacacacaacatacatcatttccccacactttgaaacttaacatttttttttcttagacccctttatttatataatcatttctttggtttacaaaaaaaaaaaaaaactttatatataccacttaaaagcccgtttatctaaataggaacaactttttttctttaatccgattttttttttttttgccgccagttattaaaaaagtaatctctcaaggtattataaatctacttatggacttgacatcttctaacacatgtttttcttgtaagcaccagtctaaaattaaaccctaatcacatatttaaatgttaaccatgtcacactacatgcacacaactatttttcgaagttcatgtagctttgtacgttcatcatctaggctttcaagaagaatacactacaatttttcctacttaacaggttctagtaaggcttaagtagtaacccgccaaaaaactaacgagtagagacatatacttacggtcaatcacacgactcacggttaactattacattgtacatactcgtacaaatatacgtactactattatattgacattttggcgttctttaattctgtgcctgcttcttgaatcatgattgagatttgagacaaatatatatatgaggacatagattacaaactcggctgaagtttcgaaatgagaaaggaataatctatgaaataaaaggatgtcatacattcatacaatgaatccatgtagttagacagagattggacagtttaaattttaagtttgatataaaatataacttgtttaaccattcacgattgtgattgattgaatatgtcaaattcttgactgtaggaaatccgaatctgaaataaaaattagaaagaggtcacaaagatttggacaagtacccttacgggagtacatcatcaagcatgaaaaccaaaagtgagattattttaactcaattacaaggcacttgtttaagtgttttttgtttttttttttttttaagaaatcaaaatataagagtgaaaatatgtttacttaaaatttaaaaaatattttcaaaaactgacctaaaactgaaaacaacaaatcaatattttctacatttttttaaagaagtgaaaatttaatgatatcttaaaatagttttttcttgatatatgttttttaaatcttgaaaatttgaaaatgaaaataaaaaataaacactcaaaaccaagtacattttagttgtcttaaatttaagttttaaatatgtacttatatttgtgcaaaaaatagaattatgtagttgtattaaatattctgatattttaaaaaaatgatacacaaaaatatttcttaattcttgaattgctcttgatgattttatcccaatcccaatttcctgattaataatgcatttgtggggaattaagtgattatgaaggttgttgagggagagggagagtttgtgattaatatagaggtgtttggttgttccataagaagaaggaagcttgatcgatgggttgcaccgacagctccctctcaccaacgctgcaacagcagctccccagcggatgaggattgggatgaggattgggtttgtgttggaagtagaggagatggacttttatgggtttgaaaaaaaatgacattaattaatagtgttagaggaggccaaagtaatgtaaaatgagagagaaaatgcatgtgaaatttgagtaaaattcaaggaaagttcaataatttgctcttaataaaattcacaagtagtttgattgcattagttgtggaacaaagaaatataattaatattcggaggccaacactatgagacttgtcaaacaaaagtttttttttttaagtgaaaaacaagagtttgcctatcaatatataaatagacaataaattatttttgttactaactaacttaatgaataattgataatgtttataaaaaaatacaggtatatcagaataaaacaaaataaaaagtttcacaaaaatattgagttattattatgaacttgttttcgtggttgatttttgtattgtgtgttgtaggtaaaattccttatagtcacttattttaatatttatgtgatttacatgagaaataaaaagtctgaaagctttgagacaaaaaaaataataaaaaagaaaaaacaaaagcctgtaatcaaaagaacatgcatgtcgagttaaaaaggagaatcaataacttgtatgcaacccctttttaaagcttgcaaatatacatgcataatttaaatttggattaaatatcttttgttattgcaatttaatgtatttctttaattttttgccttgtattttttaaaattttaattcttacaaattatgcttattttattttgtatctttaaagtaatttatataactctttgaacagtaaaaaatattatctaaaccacttaaaaatgaaaaaaaaatcataatttataaggatcgaaaacatttttttaacggcaacaaaaaaaatgctaaattaacattactaaaaaatgatttaaacctttaaattttaaaacacatatcaaagcgttaccctacggaatttattaaaaagacttaaaaaagtattattcaatgaattgaagggaataagatattcatcaagattatgtattcctatttaaatcctggaaagagagacaaaaattaagtaaagtcaattaatagatgcaaaagttggacaaaggagtactaactcactccaatttcatgaacctaataatcatcacaaaatagattaagaaaatcatcataaactttcctttaaaattctccattgtaataactaaaaaatctgcattactataggagtattttattccctcactctagtacagtagtcattaatccaatttgtcatattaattaattaattaacttttaagttgaggtgagatttacttgctgtaagaggtgatagttggtgaaaataagggggaaatgacaaaaagatgcgaacaacaggcatagaggcatgcgagggacggtttcgggcacgggcagcagatgccgtcattcccagcctgtcacgcggtttcacacacacaaaataagaaaacgtttattggtattaattgtatttactagtttattcattattaattatagtaataaaggaagaaagagaaagaaatgaaagaaataggaaaaattagacactcaaagtcacgcaacttacctcactcatcgtaatccgaagctgaggtccgagtggtaacaatcaggctcgagcctcactgagcttctcgaaaaagccaatgcaatagtcattaatccaatttgtcatgttaattaattttaagttgaggtgggatttacatgcctcaagaggtgatagttggtgaaaaaataaggagaaaatgacaaagagatatgggtaacaggcaaagaggtatgcaaaggagggttcaagccatgagtagcaaaagatgtcgtcattcctagccagtaacgccatttcacacacaaaataagaaaacatttattgatattaattgtctttactagtttattcattattaattatagtaataaaggaagaaagagaaagaaatgaaataaatagggaaaactagacactaaagtcacgcaacttacctcacccatcgtaatctgaagctgaggttcgagtggtgacagtcaggctcggacctcactgagcttctcgagaaaagccaatgcagtagtcattaatccaatttgtcatgttaattaattaattaattaatttttaagttgaggtgggatttacatgctgcaagaggtgatagttggtgaaaataaggaggaaatgacaaagatatgggcagcaggcaaaaaggtatgcaaaggagggttcaggccatgagtagcaaaagatgtcgtcattcctagccagtaacgccatttcacacacacaaaataagaaaaaatttattgaaattaattgtatttactagtttatttattattaattgtagtaataaaggaagaaagagaaagaaatgaaggaaatagtgggaactagacactcaaagtcatgcagcttacctcacccaccctaatccaaagctgaggtccgagtggtgacagctaggttaggacctcacatgcaccattgaaaataatggagcctcccaaagcaaaccaagagagagaaactcaaatagggttttagggagagatataaagagagtgagagtaagaatgcaacaacaacaacaacaacaacaaatgatggatcagatcgtaacgaagaagaagagggggcgtccctccaaggcagatctggcttgccgttccgacaaatctttggccacctcgcaaccagacctccgacggagtcttcgtcgccgtcggaatgtgtgctacaacattgactacctcaacgaggaggacgaggaccaggaagaggacgagaagaggcacaagaagaagttaaagctcattgtgaagctcaacaacaatgaagaagacaatgatgaggatgactatgagccgagtcgcaaaggggagcgtggggtgcacgcatcatatgaaaagggggaagaagaagaagaagaaaaagggaatgaggaagcgaatgagtatgaagaagagcgtgaggtaacgaaacaaagtgttgaaaatttgagacaatgtctacctcatttttttggtaccaattggtccataattgaattatgtttactatctctctctttgtgtcgggaatttgggggaaataagtaactaacgggtcaactataaaaaactaacacatacatccagactctctggttgtgtttgcttccattttattaacccccatctctctctatgactataaattagataacctaggacccattgttgtttgtctctgtctctgtctccattgcatatttttattacataaacacaatatttgccttttttttttggttttgggttatgttatttattttgtgtgtatgggtttcttgtgataggtaaagggcataaaagtggattctaaagggctttactctattccaggtttgtgtgtgtgttttgttgttttggttgtaatgtaattcgtaattcttaattacataatttcttactttttttaaaaaaatgtaccatgttggatactgaaacaggtgtgccattgtttcttttattgcattgttctcttgagtttcttaactaggttctttattttgtttttgtttctagtgttaggaactccatcaaagcttccaccttggatttcgttgcctgacaagaggaccttggagtttatccttgacaagcttcaaaagtaaggcgattttgtttcccattttctttcttcatgcattcctgttggttttaattgtggtgaatgatttgtataacatcttcaatcttcaacttttattgttgcatggcgatgccatgtcttttggtgaattgacaggaaagatacatatggtgtgtatgcggagccagtggatccgaaagaggtatgagggcttttcttcctgttaattgttaatcttgcttttggaaggcaatctaagatgaaagttcaaattatgtttgaatgcagcttcctgattatcacaaagtgattgagcatccgatggactttgccacagtgaggaagaagttggcaaatggatcttattctaccttggaacaatttgaggtgtgtaaatgtgtcagttgttactgttgaagttggggatgttccttttcttttctgagattttggttatttttgcaatatgattatgtgggttgtgagcaagaggttgttgcatgctatttatgtgaggggaaacatttaaatggcttacttgtcagtataatagagtttgtcaagatttattcacttatgttgataatggaattgtgtaggcaatagtgatttggatgtttttgattgaaactagtggggaacttttgcgggagtatactatttataggaatcatatgaaatttagcataagttatatgtaccttgtttttttcccttgaggagtatgattttcgaaccttgtgcatttttttatcaacaaataaacgatttcattgatcaaagagatataagatataccataagtaaataatctaaagaaaagaaacatccaagtggctatctagttggttatgtcatatttggacgaatgattacccaatatttcataaccaactttcagtttctgtaaaacttatccccttgctcgagaaaaatctctcaaacacctttcctatatgatcatcccaaacatgcatacacattgctagcccattgttgtaatgagtatgagagtttagtgggtggatgtttcaaccatgtccaacttacatatatgacctcctataggattttctttgaattaaaaatgccattgttgaagatcatgttattacgggatctccatgtacaccacaacaatgcacaccatataaagactcattttgttgttgcctccttcaaagaaataaccactccactgttgagatatccttccacttataacatagtacccaccaccactgagcccttggactgagaaataacaaatgttcaattgacttcaatttctctaagcaaatagggcatgatgcttcttcctttactatatagccacacatctctttttaacaggttgggccttgttggtaatctgtccaacatggcctccatatcatcactacaactttcggtggtaaattggtgttccatataaatctccatatgtcatctgattggtcattgccattgtctacctgcaatgatttgtaggtagactttgttgaatatattccttttgcctcaataggccattcccacctgtctggttggtctctttgcatcgacatcgaattcaagttttgatataattgttctagagagggtttctcctaatcaaagcactctctatgccactcgaacgtccactcccaaacctcacccccatcttccaacacttgcaacaatcctatcttgttggttagaaatatggaagagcctaggatacttattagctaatgactcacgacctaaccatgtatccctctaaaatctagtatttttcctatctcccaccctccatctcactatactatcaaaccaattacctttcttcccacccctacacccttttttaatgttcctccaccaaatcgaatattctcttaaagaattatcattgagtaaatattttcatgctctgtaatttgactccatcacattgctccacaacatgcctttttggtggtataacttgcacctccattttgctagtaatgctacattaaaagtaccaaggtaccttacccccaaacctcctttatttttatctctacatatctcatcccatttcacttaagatattttcctatcaccttcccctccatcccaaaggaaccttctttgtatggacatattttttttcaatacaccacatgggatcttaaataaggaaaagaagtaaagcggtaatgatgaaaaaacaaaattaattaagcacactctatctgtcattgagaggatcttatggctccacccactagtttcttctcatacttttccacaataggtctccaagtcgcttgtcttcttggattagcgccaattgacatgtcgaggtacacaaggaactctcaagaacctacaattcaagatatccgcaaatctctccacttcaactcttggcaagcctaaagctccaaagcaactcatggaaaaattgactttcaagcctgatactaactcaagatctcaagatgctcttgatgtcaattacattgttcaattttgtttctcccaaaaacaataggttgacctccaccttgtctttaccaattagagacccatttttaaagcttccatcatcaatcaattcaacccttatgccactacaagaaagagaaatggttccattggatccctttgtcaaagacccctttgcatcttgaaccacttgtatatccgcaaaccttgtgcattaaagcagctgctgaatatccgcaatccattcaaacgttgtgcattaggctaccccttattatcatctgaaccatttttaaaccgtacatagtatattgtcttcctgatttagtgattttgaaaggcaaataaatgatttgaatgcaactgttgaatgcagagtgatgtatttttgatttcctcaaatgcaatgcaatacaatgtggcggagaccatataccacaaacaggtataaaattgactgctttcccttgaaaaattaacgcaagtagcaattttgttgtgcttgctgtatgatccctatatatttgttacaggcacgatcaatacaagaactagcaaggaaaaagtttgaaaagttaaggattgattctgaacgttctcaaagtgagctgaagtctgaacaaaaaaggagatctaattcccttgttaagaagctagaaaagaggccgctgggtcatgcttcacaggaacctgttggctttgattttacctcaggtgcaactcgtgctactattggtgatgtactgccaacttcccttccaatgcaaggtgttgtatgtgaaaggcctggcaatattgatgcccttctggaggggaatgctttattgattgatgcaaatcaagagaaagcagaaaactatatatcaggtatcacagaagaaatgtctatttcatgctatgatacacagaaacaatactgtatcggatacaatgatacgattattttaaaaatatatataatacattacgtgtaagatacatatataaaattcataaacatgataaatatataattataattttgcaaactaaattataagcatacttcttgaacattagtaaaaaaaattattgtacaaattctgaattgatgagaaacttgcattccatttaatttaattgaaattcccttacatgtctctaatgaaaaataaaattataaatgattgcatgtcattataaattactttctattattttgaatataggaacaatactatgaatcttattcctttcttaaaatcatacataaagagaacaatttttatttttggttcattaagggaaagtgtttctatattatacacgcttacatgtttcttgtagttgtattggactttcataaaatgctttaaaagcttggatacttcaccactaagtatatcggtaaagtatagaaagagtatcgatattagatatgtgaagcaaattaaactattaattgttggtgctttatagatttggatacttcttcggtatgtatcgatgaagtattttagagtattggtatcggatatggatacgtgaaacaaattgaagtatatgtgcttcatagatttcatgccttcgttgttcaactttgcatactctcagttggatattactgtcattatctagctgttcgcttttgactgttactttattgtttcagggagggatctgctctccaagttggaaaggaaaccatctgtgcaagataatatgtctaatctaccagctactagatcggattccatatttacaacatttgagggtgaagttaagccacggctagttagtgtatgtatcaaaaggagtgaattgttatttctaatccttgaatagtttagctttcttgtttaaagcattaatgttgtatttttcggcaccaggttggaccacaagatgaatattcatatgccaggagtttggctcgttttgctgcaactctgggacctactgcatggaaagttgcttcccagaagattcagcaggcactgccatctggctgtaaatttggtcgtggttgggttggagagtatgaaccacttccaaccccagtattaatgcttaataatcatgcccagccacaacctagtttagcgactaagttgcagtctactactgaattaatagaggttgaaacaaattgtaagaatgtggaatccaccatggaacaatattctgttaatggaccaatggatgagggaaaacagccttcagcttgttctagtagtgggcttacatcagatgaaaaatcatccttgtttggttctaatgaaccaagacccaattctcatgtcaatctcttttatcagcagctcaatgtccaaaccaggaacctcaacaattatgagaacaagggtttgaaacaagtggaattcaactctttaccctcgagtgatcagaataatgcaagtctagttgcaaagcttacaagtaataatacagctgcagcagtgtatgagcccaaagaaatggtaccaagtaacatgaatattggttcccaatctcctgtgtcacctgcaaaacaatcatctggtgtgctggttgactctcagcaaccagaccggcaactatgacatggaattattgtatttctgatgtggatgcttccacaggaatattgactggttgtggaatttcatccaaaaaccttcttgcatgcataaaaaaaaaaaattgttttccttgtgctacttttagaacagatgaaatgaataccatgtgcttgggaagattgttttcccttggatgcttatgttgggaatcttatgatggttttcttaagtaggatttgtgatcgccacagaagacttgagcagatttggcagaaaacaacttcaagactttccatcttttccagatgagaactaccgagttaatgcagcatgtctgtgttctatcctagagttgaaaccatataaaacatttaggagtcgttcatgatcaagcgttacttagatttttcaattagcgggcaataaatcctgttgatgatgctttctacattctttacaaatggttgaaattcggttgccttgatattgatttcattatgattacttgtttatctgaattgatggggaaggcatcacttgtttttagttcttaatgctgctatatttttctgtacatgtctcgaatgcaaaacctcaacttgcttttccttgtttaattttacccgactctgctagttcaacatttaagtaaaatacggtacaccccttcggaactagtgttttgggtgtttcgggtgtaaatttgtttctaggttgacataaatattatggaggttggagtagcttgtgattattagaagtatcaaactatggaaatatgaaggttgaagtggcttatgattaaaaaaagttgttcgaagattgatgcatttatttgaaacaaactaaacataaaaatggttaaattatgttcctcagttctcataaatgactttatttagttttaattttctttggaaatacgaaggttgaaatgacttatgattaattttttttttttctaagtctcatgcatttatttgaaatgagctcaatattaagatggtttaaaattatgtttcttaattagttctcataaatgactctatttcattttttattttctatttttttaaagattctaaaattgttttagttattgtaaattttaacattttcaaaatacttttatcactattttagtgacaatgtgacattaatttgttgcattacatattatctcataattattgatgctagatgatttatatctatgtcatagttaaaaaataatatgaacaaatcttaaaaaaattaaaattgataagaattaaaattaacaatttatttgaaagattaagaccaaatgaagttatttataaagattaataacttaaatcatatgaaatttgatgagtttagcttatttaaaaatacgatctaatgcggctcacgagaaacaggctcacacttgtatgtaacatgtttggttggaattacataatgtggttattcacatatattggaagatgattgacttaaatcattttttaataatttttagtcacttttaaggatagcaaagagttgtcttagacaaggatttataaaacctgattataatatattttttaaacctaaaatccgagtctaacctatttatataatatagatattttaaatatctgacctaatcttttaaaattttgacctagaaatcctaattagtaaaatctcctttgtaataaaaccttttaaagtagcttagaatcttccctttaaataatctaatgaacttaaaattatatgtaaattaattagtttaagtttttaattaaatatattagcaagacttaaaaaaaacatacaaacaagaataaaatatcaaaattaaatatcacgcacagtgaaatgttaatataattataattatgattcaaatacacagatttattatgtctgaaagattttttaaatgatttaagatttaattttttgaactaaataaaccttaaattaaaacaatagtctaacttgtttaacagatagacttaagctacgtttgtttgtttaatatggatttggcgagaagttacccattagttcattgcgttacttattcccatatcccttgtctcactctcacccctaaagtggaacttagggcttttgaaagtaattgaataaataatagctttgtcaaccgcggatttggtcagttgcatgtccctgacggtcttgatgctctgaaggagctgatttgcaagcagggaattctaatccccatcataatgtggtttatttggtgtgctaggaatccagcatttgagatgattgagagtctgtttagatataaggttagaagtctttttgagagcttctctactgaaaaaaaaaaattatatttctaataaaaaattaaagttttcaaaagaacttttaacttatatctaaacaaatcctaaacttcctgctttaaggtctcagcattggttttgggaagcaaatcaatgcacgaatcagcttcagctgttgcatgaagctcctcagactcagatgttaaaggatagtcttatggtggatgctttggggattaagtttcctagaataatgatttaggcttgttggttgttttttgttttccttttttctcgtttgtaaacaaaaaaaaaaaagtcagtttagctctctctgtcagggcattttggagtgatgaaaatgctcatgtgtaactactctatcttcatttttggcattttcaaatcctttgtaacattaatgtacattaccaactgtttctgtgacataaatacagaagaaaaatctttgatgagtatttatgatgcaataggaagaaagataaaaataaatgagataccggatgaacatttaaaatagctagatggatatatatattcactcacacaagaagcattacttaatcaagtagaaaagtcgaacagaattttccaaactcttatattgattcaatacatatactaaagagcttttaagctacaaaatcaacccgtatctttaaagtatacttcacaaggatcacaaacagggtagcatatgagagatctataagttgttaattaataactgaacattaaaaataaaagttaaaatatctttaagaatttaagattactagaggtagaatttataaatgatatagaataagctacgccgttgtacaacagatgaaagcgatcaaagaatcaaatatgaaaccaataaaacgtaaccctgtagtgttgatgggctgatggcatcatgcagaacctgagcctctctctctccattcacaagagtgatatatatatatatatatatatatatatatatatctaacaactagaagaccttttggcacgacgagcaaacgaaatccgaaggctatgtcttgatttcttgctgttagataatgtctgtggtttccccatgtttgccttcgggtttttcagaacacaaacattcccatcgcatgtgtatcttttggattcttctggtgagccctcggagaagcacccgaagatgtttgagaggtacatagctattgagaataataactaatgatcagaaatatacaatacaaatttactctcaaacgattatgtgatgccaccccgttgtgtatatatagttctggtaattgcggccactataattaatgtatggtcaaggttggcttgccgcttcaaaaatatcttttccttatttgtttatcaatatttagggtcacgcgttgccttcattcagagaaactctcacattatatggtcaaatggtttattagtatcaaaacgtgttagattattggttgcttaattttccgcgtgttcacatcttccattttaaattgcttgctttctagaactgctagtattttttttatcatatacagcttggtgcacacacacacacatatatatatatatatatatatttatatttatatatatatatatatataggagtaggaactctgcgtgacgtcgtatatatgataacaaacactgctagctgaaaagggaaatgttaacaactgaatatacttgtctaggaaataaaagtaagaaaaaattaatatttattatattgaaacataaaaatcatataaagtactccttcattaatttaaggataatggttccggagtcttcattaattttttttcagaagaaaaaaaaaacaaatgtaagatatgttttagcaacaaacacaatatgttttcgttaatgacggtaaaacaaatctgtcaaaattcgaaagaaaaaaagaaaaaaagacaaatatttgcatgccgacgactagtcaccttgcaaggggtcaaagcacgtggattgcaaacaacaaaaacaactcaactaacccatggtatgatacatcgacatcgtcaaaattgagttaaaaagacaaaagctaatgtatataggtattgggaactccaaatttaagaaatgaagttttacccactctgatcaacaggtatcgttgttcgctgaacagtgcacccgtcatattttcaattgaactagctagtattcaaatcttcatcttcagtattactggataatgatgaccataattttttgagtctattgttcaaatgcaagagtagggataagaagatgataatacataaaggactagtatagttttagatatgtgaagaatatgaagttagaattaatcagctactaaaagattattaaaaaattgtattgtttttactttgtttaatctaaacattaacatttcttgattagtttttttcacgactcttgtgattttaaatgttttctaaaaatatatgaaatcctttcaaatcttataaatacataatattatatgccatcttttaaattcttattatataaattcaataaaatttaaactataaaatcttgattataaaagtctttcttttatatcaaaataatatttttaaatctaggccaacaaacctaaatagaaaacaaatgtatcaagcttttattaatgttaatattaataattttatgcatatattaaatatatatatatatattatgaataagccaatctattaagtttaataagctatttttaaagtttaagtcttatctttttaattagaaaaactttttaaaaaagtctaagtcaaacctttttaataaataaatcagattaagccttgagccctttctacctctacttatgacttgttatggttggccaccaagtattaagcatgtactatatgcgtggtccataaaatatattacactatatgtatggtccgtaaaatatattgttaaataataaatttattttacaatagtaacaacgaacttaagtccattagagactcccaaacaacaaatttatcataggttcatgaaaactaatgaacgtttctgacaaattaagagacctaggttcatgattttagatacctatttacattctcctcaattctctattcaattaaaccccaattattcattttaattactaatcatgaaatattattttaaattaaggtaattaaattaaacacattcctcccaaaatattattttaaataattaagtgaatcaaataaattatgaaattttcaaatatctttaatttcacgaaatctattaaacataaaaaatacaaacaaattcaaaaactcttagccttttaaataatttattgagtagaataagtataaaaaacatgaataatttcaaaaactttttaagtgtgagggagatactttgatgtttaattatgcacaactttgtgaatacatgtgtgataaaattgttctatttattgcaaaaaaactacaattttttttattaatttgatatatagactttgaaatatattagttgataattgatatataattaaattatacttgaaaaattaattcaaatttttacttgacaaaaaatataataaaataaaattttaatttatattaatataatatagactttgaaatatattaattcataatttatataattaaattatacttaaaaattaattcaattttttgtttgacataattgcattagtaaattttaatagaagtagaaaataaataagtgtttacttgaataatatgatttttttaaagaattaaaattttataaaaattagtttaaaaaaatgttttcaaaaagaaaattttgaatgaatattaatgtgatatataatatatagaaattaaaattataaaatattaatttctctagataagttatacttaaaaagcaatattgatagaagaatttgatggtctgacattataaaataattttacagtattctttaattacaaatcaagttggaatgactttcaaaataattattataaaaaattaaaatttatcgtacatgataataagatatgatttaatgatattataaaagaaatttatgtaattgactattaaactattttattcatcatatatcctatgtaaaataaaaaagatattgggataaaaaaataataatttagttgaatggagcattaacaaatatattaagtataaaattcaaatacaatgttattaaaaaaaaaattccattcaagatgaaggaaaatttaaatgtatattaatacaatatttagaattagaaatatactaattttgactttatataattaaattatacttgacatgttgatagaatatttaatattattaatatagcatttatataaatattaaaacaaatacattttattatatactacgacacaattttggtatttaattataatatataaaatttattttataaaatacatttaaaaaaaagtcaaatggatattaattatcaagataagttgcttttattagaagtcaccacttagcttgatctccaacccggccaggtctcttacctccaccattgcgtcgtggccacaatgcccctacccttgttcggcaagtggaatgctttatggtctatagtcatacttattttcactaatatattttttactgcaatttcactaatattattaagacttatatttctttttttaataataagtactaagataaacacatttaaaaatttacatattaataaaagatatattatgttaaaaaaataaaacaataataaattaattccccgtgcattgcatggacttacatactagtaaaataaaaattagaacatcaaataaaaataattttggtattgtttcttcttttttttcctaatcttcttcctaatttttgggaaagctaaatatatataaactaaaaaaataaatctacaaaattttgttcttcacaataattttttttaccaacataaaaatatgccaaaaatattttataaagtatattagtaatattaattttttataagaaaaagtctaatcacgtttacaaacaatattataaaaaatacataatttaaattataaaaacgagcacataattcaaataaatcaattatttcttaaacacgttatgccttgaacaatatttgattacacattgagaaattttttcttaattttaaatttttatttataatttttgcttttaaaattattaattgttattataattatagtgtgattttaattttaaacttttgataattacagtaatatttatcaatcttaattaaaattgtattcttaaatcttaaaagtaaaattataaatccaataacaacaaaatcttatgattgattaaaattaacgtgttttatttgttttgaataaagttattattgaaaataaaatactctataactttacatcaccaaaacatatatattattttgaaatttaaattatattttctaaattcgaattacaatcttgtaaatatttcaatttcaatgcaattcaacaaaaaaattaggtagaagattataaaaaatatatatataaatataattttgcttgaaaatttcgcatcatttactaatcattggtctttaagaagacttattctcagaatacctttatatactgcggatgatttgatagtattccaattttttcgctttgattttttaaattattatatttttattagttgtaaaatttgttaggtttgtgtatactcatatataggtacagagagagagagtagagaaatgaaacctctaatatgcaacgtagatacataacaatggcaaatgaggaaaagaattcgggaggagctgtaaaaaaagaaggtgattcggttgatatatttttgaggaagggtatccgtgcctggcttacactggaacaacaaaagaatcctcacttattttcattcctccaggatgacgacactgagattttgaatagcatcctcagaagacaagaccaaagaaagagagaagaagaaagaaagagagaagaagaaggcacgtccacgaaaggtgctagcaatagcagtgctaataataatgttggagattccaagaattacaaggccatgtgaagatattaaagattcaagaaatgaagggatgtgaggtgaagtttgttggaactagctctccctagatctctgaatatctacaagcacttcagtttatctttgatccaaaaaataaactctatgcatttgtctttaagttcaaacaataactctgttgcataacaatgttatatatcctttagttgtttatgtaacaaattaaactgactcgtacttcacttatccatcaataaattcagatcattcttttcttctatatggtatcacaacctaattgcctgtgtatagggtaccactgtctgccctcctaaatccatcaccatcaatggttccggaactgatcgagaatccaaattattttttaatgttctattcaagtaaattattttttttaatctgaataatatgttattaatttcataaaatatatcttataaacaaacaacaccgtcaccactgcgttcgccacaattcccctccccttgttcagtggaatgctttgtggatgctattgccgaagacaattaccctgtgctgcatgccagattagtgaaggcatcaaaggtccttgcatacgtttatcaatccatcacgatgataatgaatcatatttatctcaaatacttgttagatttcgttgcaatcaattaatcatgatgataattaattataagttttattagtgattaataataaaggttttaaattgcaattgcaatagttgaaattttttaaattctttgtataattcaatatgatgaaagttgctttgtcatttgtgactatggtaggtaactgggcatgttttccagccgatggtgacaccagatgttgagatatatatgcatgccatataaaatattcaaggaatggagacttaagtattgctttgctaatctctttataaacggggagcttattgtgtcctccacctctgctcaaaagtatcttgcaaaagttcaaagtttcaaaggatgccttaaataaaattggatgttctatcccctcggttaatatgaagtctcccatcaatatggagctaacaatatacaccaatgagggtggtaccttggctgttgaagatgccaaaaaaaaaaaaaaacacttcatgattattatttagatagcagtacaacttggtatgtgaaatcacgaggcctattgattactttgatcatatgttcgtgaaattgagagagctaggttgccttatttgtaaaatgtatcaatatatcaaaaaacaattaataaaagagatttcaaagttacttcaatttgttgcaaacaaatgaatctacctagaccttgaaaacatattaacttattggaaagcatcccctgatattaagtaaaatatgtagacatgtaatccatatataaagaaactcaaataaaagttacatttataaataataacaatgtacgtaaattatatcaattaaaaacaatttggatcgataaacaaatttatgtattttgtactgttcaatttaattatagtcaaacgctaggctgaaggaagagataattaacaggaactagaccaaaagataatgatataagaattaaaaaattattatttaatcataagacaaatttatcaaacatatatgtattcacgaatttgtatatcattaaacatcaaagtatctcagcacacatttgtccttgtcataataactataaaatcttgttacacacatacaatatcaaatgtttaagtggaccaaacaaaacattttatttttttcttatctcaaaaaagtcaactttgcttcaaagaactaatgcttactgggcaagaaaaatgtctcacacatgcaagtaaatagccttggagttaacttattaacattagtaatgaagatcaattcgagggatatatatctattttttatgattttgttatgaactaaaatgataataaattataaatttttttagtacttggatgtgtaaatttttttatagtcaaacactagtaataaagatcaattcgagggatctaacttgatttttttatgattgtgtaaattttccgttttacacaatgattagagattgttgggtgtgtagtttgaaatctattgctcccatgctattaatattattgaatgtattaaatgtattaagtagtaataaaattaaagtagatttatttttgttttgtaaggattaatttaatgattatgtatttttctttgaatttttattttgaataaaatattgttacaagataaagattaaattatattttagataaatagttatttttgtttcatataatattgataaattcatctatgaatatcttaattaatcttttcataacgaacgaaaataattatttatccaaatattattaaaattcaattcaatctaatacttttttttcaaattttattgtttactatttgcagtccttattaaattgattcagttatcaatatgtcaattttttttcccgtccaaaaaaaataactgaatttttttattagacagagactacatctagactcatggatatatatatatatagaggtatagagagagagtagagtaaggaaaacttctctaatctgcaacgtagatacataacaatggcaaatgaggaaaagaattcaggaggagctgtaaagaaagaaggtgattcgattgataagatactgaggaagggtatccgtgcctggcttacacaggaacaacaaaagaatcctcatttattttcgttcctcgaggatgacgacactgagattttgaaaagcatccacagaagacaagaagaaagaaagagagaagaagaaagaaagagcgaagaagaaggcacgtccacgaaaggtgctagcagtaacagtgatgaattgccaagtccatttaaagaaaagattcaagaaatgaagggatgtgaggtgaagttgctgatacagaagaaactttctgagtcagacttgaatccaaacctaaacgatgccagcttctctatgaaaattgccaacaattttctgacacaaaaggaggagtcctttctagaggaaaacgaaaggatttctggcatgcacgtcattgtgttggatccttctcttagagagtgcaacatgtgtttcaagaagggttcaagaagctgcttctacgacttgaccaatggatgggacagaattgtgcttcagaatgatctcaaactgcatgatatgcttcaggtttggtccttcagagtctcctctcttctctggtttgcacttgtcaagctgtgaacgaagatgccgtacatgtgatgtgatggtctgttatttcaatcttgataattactgtaaaagatctatgaatgatcaccctcaaaatcctctatgtcaatttagaagggtctgaagatattattcacttccaacactttcaagaaataataaaataccaattttctttgcttgtacatttatccttcatttactgcgttttcatttgtgtctttgttcccttatttctctttataaactagaaactcttattgcacccttttgattattcgcttgtcaaaatttctagtaaggttattaaagcatacaaatgtttttttgcatgtgtcatgcattgaactcttaagcagtatagtcctttgcagtgctaagagagggtggaaatggcatgggtaaaagcaaggaaatgaattatgtgtaaaaggtagtagtttatattatgtatgaatgattatttctattaattagaagctcactaagttctcctctaaagagggtgtctcctacgagcatttggagtttattggagactccacctctcaatcacaccatcaccaacaacctttatcgcacttaccctgatctccaaccaggccaactctctcttctacgtgctgtcaacactagcactgtgatatgtttgcgttgttcagatagcaacagtatccttcattcacatgacgggatgaaaaatctcgaaaaaatgatgccgagaacactattgcttccttgatgcttgtggccttaaaggagcataatcatctgtgagtgagaatgacgtgttattaaggtgtctcccatctcctgttattattgggtattgtttaattaaagagtagtgcaactcggtatatcaaatcacacggcctatttgattactctagtcatttgaaattgtaagagctaggttgtcttatttgtaaaatgtatcaaagtaactaataaaagagatttcaaagttactttaatttgttgcaaataaatgaacatgcctagaccttgaaaacatacatttaacttattggagaggatctcttgatatcatgtaaagtatgttggcatgtaattgatatggagaaactctaattaaaataatttggatcgatgaagaaatttaagtattttgtaatatttgatttaattataatcaaaagataggctgaaagaagagataattaacataaatttggcgaaagaaaataatcagtgttataaaaattgatccggtcattgtctaagttgaggtagtaggtcaataggtcagtggtccaaccggtggacaagtaattggtccggtttgacccaatctatattaaaaaaattaaaattatattatatatgtatataactaacattatttgattaagaaaagttcattcataatttcatactcaaaaatccaaaataacaataagccaattcgaaatgcaaaataaaaattgtagaaaataataaacgggatacaagaagcaacatctagtcaagcccatctaaaaaaaactaatctctcaatatatatatatatatatatatatatatatatatataatcttctcattttggcttgctgcagcgcccccgtccaccaattttttcttcctgcttctcccttgcaccaaattcttctcttcgatcatctctacatttggaggttgttctctctctccctccacgacgatttcctccgattcgtcgccatcgacgttgctccgtccgaagtcattctcacttcctccatcaccactctgcaccgcgtcgcacccacacacgctagtaacaacggagatggcgtgccctgctgcagtgagcgtgagtgcctgaggccttgaactaagccgtgaacaaatgaagaatttaagatgaagaaaagttgaagcttttttttgggttttatgcgtctgaagcattttttcctggggcatcaaaacgacgccattttgtgcgtctgaagcttttttttttcttcaccaaccccgtctgggtcctaaaaaccggcaaggtttttggttcttcccaaaacggttttctctgggccacacgcatggccgattcattagccaactcagcccaattgatgctaggttcccgattcaaccgctccaactggccgattcgaaccaattttaatatcattgaaaataatgttagatttcataaattattatttaatcatatataagacaattttatcatacatgcatgtattcagggatttgtgcatattaaaacatcaaagtatctcccacacattttcctttgtcataataactataaaatcttgttaacacatgcgattaagtgttaagtagaccaaatgtacaaaaaacattgtattaaagtttttttcttatctcaaaaggggcaaccttgcatcaaagaactaatgagtacgaggcaagagaaatgactcacacatgcaagtaaatagccttggttcttgtttatattcttttcttttctaatcttaaaattaaagtgattcttgaagggcaggcaacgcattatttcatatatattagcacatatataacaacttattttgtttgaacttatagtggtcttataaatttagaattgttaaactgatactcttaattaaaaattaaaatcagataaaaatagcttaaaacatggtccatgaaagcacaacatgtagtaaaatatataacaactctcagactattcttggattttcaatcatacagagagaaaatgaccaaatattccaaactcaaactccttagttatttcataaacgcagccataggttcaatttcataatacaagaaaggtggtagtggtagttggttagaaaccatgaatgaggaagtgagaaacgttcttgcgctgatcaccttggagttggataatcttgccaagctccttgtcatgcacaacattgccattgcagcaaaactctttcttgaggtctttgaggatcttctcgtagctgaactctttcttcagcccttgcactgtggtcagactcttcttcccattcctctgttgtatgcggatatgcacatactcttttgccccgggggcatctgtttcttttgcctccgcaaatgggtcgaaagtgctcgtagggatgtgataaatacccacttcaaccatatatatatatatgtatatatatgaaattttcaagataattttttgaagtgattgatcatccaccttcataataaggaaaaatatttttagaaaaatagaaagtgctcgtagggatgtgataaatacccacttcaaccatatatatatatatatatatatatatgaaattttcaagataattttttgaagtgattgatcatctaccttcataataaggaaaaatatttttagaaaaataaatatattattttaagttttaatatatatatatatatatatatatatataataaataggccagcctgatatacctaacatgtttttttttaagtttgagcctgacctttttatttaagcagacttttcaaaaagccttaacttaatttttatagtaaataagtcaggtcagcccttaaataggtcaagccaaaagtccctgatagacggcctgactcactttcacctctatctccaaccaacccggccaggtctcttacctccaccattgcgtttggccacaatgcccctacccttgttcggcaagtggaatgctttatggcctatagtcatacttattttcactaatatatttttttactgcaatttcactaatattattaagactcagttctttttttaataataagtactaagataaaacacatttaaaatttacatattaataaaagatatattatgttaaaaaataaaacaataataatattattattaattccccgtgcattgcatggacttacatactagtaaaataaaaattagaacatcaaattaaaataattttggtattaattgtttctttttttccctaatcttcttcctaaattttggcaaaactaaatatatataaactaaaaaaataaatctacaattttttttctttacaataaattcttttaccaacataaaaatatgccaaaaatattttataaagtatattagtaatattaattttttataagaaaaagtctaatcacgtatacataatttaaattataaaaacgagcacataattcaaataaatcaattatttcttaaacacgttatgccttgaacaatatgtgatttcacattgagaaattttttcttaattttaaatttttatttataatttttgtttttaaaattattaatttttattataattatagtgtgattttaattttaaacttttgataattacagtaatatttatcaatcttaattaaaattgtattcttaaaattaaaattataaatccaataaaaacaaaatcttatgattgattaaaattaacgtgttttatttgttttgaataaagttattatttaaaataagatactctataactttacatcaccaaaacatattatttttgaaatttaaattatattttctaaattcgaattacaatcttgtaaatatttcaatttcaatgcaattcaacaaaaaattaggtagaagattataaaataagaaagaatataaatatattttttcttgataatttcgcatcatttactggtctttaagaagacttattctcatagtacctatatatactgcggatgatttggtaatattccagtttttccgctttgattttttaaattagtatatttgattagttgtaaaatttgttaggttagtgtatactcatatataggtacagaaagactagctagagaaatgaaacctctaatatgcaacgtagatacataagaatggcaaatgaggaaaagaattcgggaggagctgtaaagaaagaaggagattcggatgatatatttttgaggaagggtatccgtgcctggcttacactggaacaacaaaagaatcctcacttattttcattcctccaggatgacgacactgagattttgaatagcatcctcagaagacaagaccaaagaaagagagaagaagaaagaaagagagaagaagaaggcacgtccaccaaaggtgcttgcaatagcagtgctaataataatgttggagattccaagaattacaaggccatgtgaagaaattaaagattcaagaaatgaagggatgtgaggtgaagtttgttggaactagctctccctagatctctgaatatctacaagcacttcttcagtttatctttaattcaaaaaataaactctatgcatttgttgcataacaatgttatatatcctttagttgtttatgtaacaaattaaactgactcgtacttcacttatacatcaataaattcagatctttcttttcttctatatggtatcacaacctaattgcctgtgaatagggtaccactgtctgccctcctaaatccatcaccatcaatggttccgtaaccgagaatccaaattattttttaatgttctattcgagtaaattaattttttttatctgaatatgttattaatttcataaaatatatcttataaacaaacaacaccgtcaccactgcgttcgccacagtgcccctccccttgttcagcaattggaatgctttgtggatgctattgccgaagagaattaccctgtgccctgtgctgcatgccagattagtgaaggcatcaaaggtccttgcatacgtttatcaatccatcacgatgataatgaatgatatttatctcaaatacttgttagatttcgttgcaatcaattaatcatgatgataattaattataagttttattaatgattaataataaaggttttaaattacaattgcaatagtggaaaaattttaaattctttgtataattcaatatgatgaaagttgctttgtcatttgtgactatggtaggtaattgggcatgttttccagccgatggtgacactagatgatttggaccaaaaaaaaaacacttgatgattataatttagatagcagttattagaatgtggattttgacctaactcaatcccaaaagctagcttatagggtgagggattgttctccacttatatactctgacttggcactatctctagccgatgtgggactcaagcagggtgtaatggatttaggataggctatgatatcgtattagaatgtgaattttgacctaactcaaccccaaaagctagctcatagggtaagggattgttctccacttatatactttgacttggcactatctctagtcgatgtgggacttggattatttccaataacagtacaacttggtatgtgtaatcacgaggcctatttgattactttgatcatttgttcgtgaaattgagagagctaggttgccttatttgtaaaatgtatcaatatatcaaaaaacaattaataaaagagatttcaaagttacttcaatttgttgcaaacaaatgaatctacctagaccttgaaaacatattaacttattggaaagcatcccctgatatgaagtaaaatatgtagacatgtaatccatatataaagaaactcaaataaaagttacatttataaataataacaatgtacgtaaattatcaattaaaaacaatttggatcaataaacaaatttatgtattttgtactgttcaatttaattatagtcaaacgctaggctgaaggaagagataattaacaggaactagaccaaaagataatgatataagaattaaaaaattattatttaatcataagacacatttatcaaacatatatgtattcacgaatttgtatatatttaaacatcaaagtatctcagcacacatttgtccttgtcataataactataaaatcttgttacacatgcaatatcaaatgttaagtggaccaaacaaaacattttattttttttcttatcttaaaaaagtcaactttgcttcaaagaactaatgcttacggggcaagaaaaatgtctcacatgcaagtaaatagccttggagttaacttaacattagtaatgaagatcaatttgagggatatttattttttatgattttgttacaaactaaattgataataaattataattttttttagtacgttgggtgtgtaaatttttttatgatcaaacattagtaatgaagatcaattcgagggatctaacttgacttttttatgattgcgtaaatttttcgttttacacaatgattagagattgttgggtgtgtgtagtttaaaatctattgctaagatgttattaatattattgaatgtattagtatcaagttagatttatttttgttttgtaaggattaatctaatggttatattttgatctgagtcttctattttgaataaaatattcttacattaaaaagataaagattaaattatattttggataaataattatttttgtttcatataatacataaattcatccataaatatcttaaatatgctcttttaatacgaaaatgactatttatccaaatattattaaaattcaattcaatctaatacttttttttcactttttattgtttactttttgcagtccttattaaattgattcagttatcaatatctcaattttttttcccgtccaaaaaaaaaaactgaattttttttattagacagagactatatctagactcatggatatatatatatatatatatatacacagaggtatagagagagagacagagagagtagagtaaggaaaacttctctaatctgcaacgttgatacataacaatggcaaatgaggaaaagaattcgggaggagctgtaaagaaagaaggagattcgcgcttaaactggaacaacaaaggaatcctcacttattttcattcctcgaggatgatgacactgagattttgaatagcatcctcagaagacaagacgaaagaaagagagaagaagaaagaaagagcgaagaagaaggcacgtccacgaaaggtgctggcagtagcagtgatgaattgccaagtccatttaaagaaaagattcaagaaatgaagggatgtgaggtgaagttgctgatacagaagaaactatgtgagtcagacttgaatccaaacctaaacgatgccagcttctctatgaaaattgccaacaattttctgacacaaaaggaggagtcctttctagaggaaaacgaaaggatttctggcatgcacgtcattgtgttggatccttctcttagagagtgcaacatgtgtttcaagaagggttcaagaagctgcttctacgacttgaccaatggatgggacaaaattgtgcttcagaatgatctcaaactgcatgatatgctgcaggtttggtccttcagagtctcctctcttctctggtttgcacttgtcaatctgtgaacgaagatgctgtacatgtgatgtgatggtctgttatttcaatcttgataattactgtaaaagatctatgaatgatcaccctcaaaatcctctatgtcaatttagaagggtctgaagatattattcacttccaacactttcaagaaataataaaataccaattttctttgcttgtacatttatccttcatttactgcgttttcatttgtgtctttgttcccttatttctctttataaactagaaactcttattgcacccttttgattattcgcttgtcaaaatttctagtaaggttattaaagcatacaaatgtttttttgcatgtgtcatgcattgaactcttaagcagtatagtcctttgcagtgctaagagagggtggaaatggcatgggtaaaagcaaggaaatgaattatgtgtaaaaggtagtagtttatattatgtatgaatgattatttctattaattagaagctcactaagttctcctctaaagagggtgtctcctacgagcatttggagtttattggagactccacctctcaatcacaccatcaccaacaacctttatcgcacttaccctgatctccaaccaggccaactctctcttctacgtgctgtcaacactagcactgtgatatgtttgcgttgttcagatagcaacagtatccttcattcacatgacgggatgaaaaatctcgaaaaaatgatgccgagaacactattgcttccttgatgcttgtggccttaaaggagcataatcatctgtgagtgagaatgacgtgttattaaggtgtctcccatctcctgttattattgggtattgtttaattaaagagtagtgcaactcggtatatcaaatcacacggcctatttgattactctagtcatttgaaattgtaagagctaggttgtcttatttgtaaaatgtatcaaagtaactaataaaagagatctcaaagttactttaatttgttgcaaataaatgaacatgcctagaccttgaaaacatacatttaacttattagagaggttctcttgatatcatgtaaaatatgttggcatgtaattgatatggagaaactctaattaaaataatttggattaatgaacaaatttaagtattttgtaatatgcgatttaattataatcaaaagataggttgaaagaagagataattaacataaactcggcaaaagaaaataatcaatgttataaaaatcggtctggttattgacccagttgaggtagtaggtcagtgatccaaccggtggaccagtaattggcctggtttgggccggtctatattaaaaaaattaaaattatattatatatatgtatataactaatattacttgattaagaaaagttcatccataatttcatactcaaaaatccaaaataacaataagctaattcgcaatgcaaaataaaaattgcataaaataataaacggggtacaagaagcaacatctagtcaagcccaactaaaaaaaactaaactctcaatatatatatatatatatatatataatcttctcttcgatcatctctacatttggaggttgttctctctctccctccacgacggtttcctcttattcgtcgccatcaacgttgctccgtccgaagtaattctcacttcctccatcgtcactctctacaccgtgttgcacccacacacgctagtaacgatggagatggcatgccctgctgcagtgagcgtgagtgcctgaggccctgagctaagccgtgaacaaatgaagaattgaagatgaagaaaagttgaagcttttttttgcgttttatgcgtctgaagctttttttttttcttcaccaactcggtttgggtcctaaaaatcggtcagattttctattcttcctaaaaccgtatggttttctttgggccatatgcatgaccggttcattagccaactcggcccgattgatactaggttcctagttcaaccggttcaaccggtcggttcgaaccaattttaataacattgaaaataatataaaatttcataaattattatttaatcatatataagacaattttatcatacatgcatgtattcacggatttgtgcatattaaaacatcaaagtatctcccacacattttcctttgtcataataactataaaatcttgttaacacatgcgatcaagtgttaagtagaccaaatgtacaaaaaacattgtattaaagtttttttcttatctcaaaaaaggcaaccttgcatcaaagaactaatgattacgaggcaagagaaatgtctcacacatgcaagtaaatagccttggttcttgtttatattcttttcttttctaatcttaaaattaaaagtgattcttgaagggcaggcaacgcattatttcatatatattagcacatatataacaacttattttgttcgaatttatagtggtcttataaatttagaattgttaaactgatactcttaaaaattaaaatcagataaaaatagcttaaaacatggtccatgaaagcacatgatgtagtaatatatataacaactctcagactattcttggattttcaatcatacagagagaaaatgaccaaatattccaaactcaaactccttagttatttcataaacgcagccataggtttaatttcataatacaagaaaggtggtagtggtagttggttagaaaccatgaatcttgatctgatccttcctaacaaggcgagcatgaatgaggaagtgagaaacgttcttgcgctgatcaccttggagttggataatcttgccaagctccttgtcatgcacaacattgccattgcagcaaaactctttcttgaggtctttgaggatcttctcgtagctgaactctttcttcagcccttgcactgtggtcagactcttcttcccattcctctgttgtatgcggatatgcacatactcttttgccccgggggcatctgtttcttttgcctccgcaaatgggtcgaaagtgctcgtagggatgtgataaatacccacttcaaccatatatatatatatgtacactaatcaccaccctagctgcaacaaaatgtacaaaccataagccacatgtgacatgttcatgcatgcatgccaatatcaacatatctaaccataacaaatctaaagcctcctattaagcatttctttccttcacgctgttttattgttttgtgtcagagatcatgaatgtctctcaattcattaagttagaaactaatctcactcgaggtgcgtgactgcttttgattcaaaaaaatttgcacaaagaagaaatcaaatacaaattttttcattaaatacatcttctctcatatatgaacgcaatggtgcattattacacagttatgtcaaccttatggattaaaatcaaaatctttccttcacatcttgcaagtacatataattcgtaaggaaagtagcaaaaaaaagagaataaaatgtctttcttgtgtaatagagacattaaacatggaactcaaactttcacaaacacaattttttagaccaagtaggaattaaaaatgagctaggaagatctaatgttgaaggagagacgaacctgtgagaaaggaggacttgtaaacaaagcaagagcgaattgagaagaataggtagtggtgggggtatatatagtagcggggtgtgcgtgacagaataagcaatttaatagcagtgaaattttttaggacaaattatttacaccatgcaattaaacatttgatagtataaagtaattttttaaatgtgtgtatatattatatattgatataagtttacagatgttaaatattgatttacatgtcttaaaataaataaaaaattcttacaatgtgacaatttctcacagattgcaatgggtctaatgatggttaatagcagaatataaggtgtttttgggtggatggagtatcctattctccatgggattgatatctggttgtaatttaaggcatagaaacgcaagataatttgtgtggtatatagtagttgtggtagagaacaagaacaaaggaaagaagaatctagactcaaattgctttggagattctgttccttatgcttgtctgagtgttacagatacgaattcttttaatttttatcacttctcaatttgcattattttataatatttgtctgtagaagatcaaaagaaagatcgggacaaaaaataattgtttcaaatccttttacaaaagagaaacaaaattattccagtccaattaatcatactgcaaaggaaattattgatcagtatgatatttctgggtttttactttttatttttacatgtgagtagacttccctgccttctaacttctttccaatgcattaagtaggtttatttatatctttctgcttttaaattcaccgtaagtatataatttaaatttgaaatattttttacaattttttataatattatcatctaatgatataatcatataaagtattaattaaactcttagatttcttaaatagtaattaaaaatttatgcagatcacagtgatactttctcccagtttaacaaaaggtttaaatatatttttatctataataaatatttaatttttacattttatttctaataaatttttattttactttaactctctaataaaataacaattttattttttatcattgacaagttctaataatttttttcatttatcaaatactcaaacaaaattattattttattagaaactcaacttaaaataaaaatttattaaagaataactacaaattttaagtatttattatggataaaacatatttaaacctttaacaaaattaacatatcagattttttaggaagatgttgattataagcctatacacatgaattgtttttatgaaatttaattgcaattttatttcttgaattttaatctctcaatttctctacaaattccagtattttttttataaaacatttccaacaaaataacattatatcttcttatagatcttcttacaaatcttccaagcacaacatatatacatatccaatttcccttttatttttactttttcttttattcaaagaaggctatgattaccttatttttcaccctaccactcttaagcaaaccaatactgaacagacacaaaatgattaatacaacagccttcatttttcattttttatcaattgcataaaaattacaccttgaaatatctggccaaattagataacatgttatcctcccctcaatattctactgtgccaacacaaaacagcaaccgacaagatcatcatgccaccaggagtgagcagttaaataatgggttgatttgaatgaagatagatcataagctattttggtacagtcatgaaactataaattcaaaacaccacgctgtcgttataaaaagaaagaaaaaaaaaaaaaatcaaacattacatgcaaggttaaatcatctttaaaacgaatacaactaatttaaatcacatttgtaatccatcttgttaagaaacaaaatcctcttctgatatttccaagtacatcgcttctcttttcatcataatcaaaattttctactgcctttgacaaaccaaagaggcttcaattcattttttaaacatattgaatctcccaataatcttgtatcttcacagaagctttagatctttttccatgtacaaacagagcattgacaaggttcatctcaataactaggtgaagaaaaccaagataaagaggaaaatgaacagcaccagcaaacccaatatcatcatgatctgtccctttgcactagccttcttcatgaccattgccacttttttctgatatcataaacaatgagacacacttcaactttcacattcaacattaaaaatttccctcattatattaaaaaaaaaaaaaaaaaaaaaaactacatatttcattgcccaaagactcctccctatgcaaaggtaaggaaaaaggatattgtacgcagtcttacccttgcatatgcaaagagactatttccggattcgaacccatgaccaacaagtcaccaaaacacaactttactgctgtgtcagggctcgccctccttatattattactaattaatcacagcaatcagccagatagatcatacattttaatgcaataatggaaactcgaagcagaaactcacttggacaaaatctaggcgattagatgtactgtccatctcattacccagctcatcaataatcttttcctgaaacatcaaggctttgacaattttagaatgagaaatttcccaaggaaacaaaatcagcatgagaacacagctactattgaagacactcaaaggaaacataagcaccaccagttttgcctagtttcatacttttgaaacacaagagtaataatagaaatccgcagccttaacccgcaaggggagaggctgtttccaggatttacaccagtaacatccaactcacaagacagcaacaaggctctcccactaagcaaaatagtaagatcacagaccaaaaacttgtcaaatgtcaaatctacctgcgcaaggagctcttcatgtatagtaagtccaacacctcctattctttgtacacttaaactaagctcatccaactcctcatcttgtctcctatcagcaccaatagataaaatataagacaaaaataaaatagaaaccagagattgattattttccaaaaacacttgagcactgtatttccagcctttatctgtgttaaggctacctgccacagtctttactctcccccattttctttttcttccacagaaaaaaaggggaatccatcattttagttaatatttcttatttaatagaaatagtataatccaaacaaaacttaaataattagcaaagatgatattaaaaaacagaaatttataatttgtaaagaagcacaagaaaaatatgttcatgtgtccacaatttcatacagaggagcccacttatgtctcagaaagcatagaggaggagtggacaatataattaaatcaacttaagaggtcaaactaattaccagaatattttccaccttgcatgcacaaaagtcacggtcaagtgtcaatttgtttaatatcaagaagatgtgcacaaagtcaagtaaaagcaggacaaaagacaaatatttaattcaatgccatataaagtgagagagagaaaatgggaggaaagaagtactttataagaagcatctgcctgtccgattctgactctatgaaatcatcattatcctgggcagcatattggttagatgtagtttgatgagaactaggaagcctcattaattccttgtgcatcccatttagacaagcattgtttaagccctttccagcttgcactgctttctttgctgtgctcacctaataatgtattacaatcattcacaagcaccatacagataaaaaaaaaaaaaaaaaacagagagagaagggaatctaataggtgctagcaataaaacaatgttgaatgaactatacattaggttgagaaaaaatttgactgtattctcctaactcttactcaagttcagcatgttatagatacctgggtgcgagcatcacgggtccacttcctccggttttcaacctccacttcatcaatgccataccaagaaggatctctagaggctacagaaattgctttgtccaattcatccaccttcctatcaaaaaaattatattttagcagtttgaataggttgtattgcagaaggaaaaaccatagcctaagatgtgtggcaaagagaggctagacaaaagatgtgctagtagagttagaagtaattttctatctgttttccactctctgatttaacaaccaacaaagagtgaaaatcaaaacatttccagctcactccatttttactccccttcatctttccttacagacccaaagggaaggggcaaaatcaaattaaaagaaaacaagagggaaagaagggagagggtattgatgatcttgctctccctttattgggtggctaaaaaatacaatggggagggaatggaatgatgaataaaaatacatgaatataatgcattcactatttattaatgagctcttatattaactaattaacattaaaatttaacaatgatatttagctgaaatttacaaagatttgcatcctcacaatgatcacagagtgaacgattcttctgcttttttatgataaaaaaataccatgtatttgacataaattgcagcatatgtcagaatcattttggacagttatgtgcacatcactctttttacttcctaccacaataaaatttccccaaggaaatacctttcccttcctctgacctagattgtaatataatccaaacatccctctaacgtgtacctaataatacacaaatcccatttcatacaaatgatactagtaccacgttggaagaatgaatgaaactcattgaaaacaaaaatttataggccaaccaacttgtcagtggttcaaaaaaatacgattggtatacctgccatgcaatgctttcacaactagcaagaacttcctttgatagattggatcgctcgccagcatcagcagtcttttcccattggtgaaacgtagattgcagcttatcaatcttaccagaaaatgaaaattaatcagccaataaattacacatcaaccccaaaaccaaaaatcatagtgttatcctccaattacagatcgcagttgggttctatccaaaatccaaattttgcattaaaaaatggcatactcagatcaattacataagatattaggagcaaaaatatcccaattaataatttcagctcaggaatcaggcttgagaagatgaatcacgtaaagtcacggatccactaataccagtaacagagaaatcatacagaaattctaagtgcatcgcatgatctatgaaaaaaagaatgtaatctttattatccaaattgaaccgaaaacgaaacctaggtgatttgggaaaagagaaaatacttacagattcttgaatttcttgcttgacaacgtagaatggatcttgagccgaaggcatcgtgtcttgctgtttcgaaatgcttcactttaagcacagaaaattggggaacagtgtcacgcttcctctcttccctttcatttctcagcttaatatttttttgccaacaatatatatatgttcgaaataaatacaattagttggactttatttaaagataaatgagttaaaggaaataagaagtcatttttctaaataataaaaatgcaaacaaattcgtgtttttttcttttctttataacgagtatttttggcttttcaaacaactttatgatgtttgttattaatttttttaagttaatattttttagttcatcagaaatattataaaacaaaattgcaagatttatattggggtgataacaattaaaaagtaatgattagtacgtgaaaggctgctataaaagcaagtgaaatatcagaatatttggtgataggcttagttttttatgattatcattaataatttgataataatattttatacagttaatgttttggagctaaagttaattaattaaatccatactcgtttatattaattactgtacgttattgcaacatgcctcggttttttatttattatttaaaataatagatcataaattctaacaataattaacctcttcatttttattaatttttttttaaatttttaatatatctttttagttttatgtctcacgctcaagttagtaaaaaataaaaacaatggattgactgtaatatgataattgagattaacagttttgtagtacagtgaagtgttaaataaaatagataaaatacatgaaaattaaacattgcataaacatattgatttgccattaagtacattcagatccatgcgtaaaaaaatctaaaatggaatttattgtgttccacacatttcacatggtgatggtgtgcctcagaaatccaaagagaaaaaacccattgcttaatcaagtttcggataatatagggaagaatgccaccatgatcaaggtatgccagctccaccagcaaattgagttgctaaataagtatatatcatagtgaagccactgtgtgcaagtgcgttgatcaatcttagatgataaaccatatatagaaggcacatgaatttagaaacttacatcaaggcaaagcttgcatttaaaagatttgccaatgtcagtggacacataaacatcttgaccaggttctgtgtcaccaacttttcctggaagatcaaagttgaatcactcatgacccgtcacttcttgtgttcatcatgtttgaagcagaggggtatgatccccatcccaactagattaccacggtgaattctctcaaagctcttagcaataactcctttcaccccctatgtgaacaagcaagtgaaaaaatatttgtaaaacaagaaagcagtccaataaatatactcaagtagtgagactatggagttttactgtcatctattacaaattatgatatatattaaatttgttaactttttcaatacctaccataaaattagtactaacatgatttttgattgattaattgataatataaaatttaagctggtaatgtataataattaaacttacaaatataacgaaataacattttgtcattggtgagctcacgagtagtaaaggacccttggcagcccaatcttgagagccaagataatggtgtccagaccagcacccttttacagttgtacctctataaagtatgcacaatatcatattatgtggtatttatttgcataggaaacttcaacaaatggacttcatacaaataaaaccaggaatgatgcattaactaggccaaacaatgctttgtccattgcgaaggggcattttggaatatagaagggtatacaaattcattagtcaaatcaaaggttccaaactaacatttctcgcattctcccaattagtatttctaaccaaattaacaaattaatatttgttgataaaaaaattatcttaaacatacacttggttttctacgcatgttttcaccaccggtttaattactcatctgtgggacaattcaatagtgaaactaatttgtgtactagttcggcccaaggcctaaaacgtctttttttttttaaatctggcccagaatatattaacaagcgcttctgcacaaccttcccactcattctatttttctatcaaattgcattattctatttcatgtattttttgtattttgtatgttacatgatatcaaattgcatttttctggaaattaatttcccgagtaatgattaaacagcataaaggaatattttgggtatagagaggactaatgataataaaaaaacaataaaattaaaataaaaggggagtgtacttaaaaaaaaatatgcatgatatagcattcgccaaagaaaaatcaaccctcccatcgaaaataaggcccaggcccagcatatgcacggctaagcagaaaggttcatgtgagaaatgtatttcattttaaaattgtaatattaattctaattatgacatggacttctgggatgtaacctgtcacctaattttatcttaaacaatgacaaaaaaatcatgctcgattcagaattgacaaatactttttgtttatgtagttgaaggaaattgacttttttttcattcttgttttatatgttccacatttgtaatttatgtaaaatacgtaaatagctcattgagcttttcccaaaatgtaatatacacagatagcaagggagagaggacacatatcaaatgagattcttttaatggagagaaattagaactataaatatagattattagatcatatttatatgtttaagattaaaaaaataattatgcattaacagtaaaataaaacttttacattattaatttattagaaattattattggtattatttttatacatattaaattacatttataatttatttaaccattgaatattttgattttgaccaaagatcacgtattggatattgtatattgactaaaaatatgactaaaataaaatatataagtaggagcaaattttacttttataagttagttttgtagatttaagttaaacacaaactcacgttttataaatggaataaaagtttatcctaataagtgttgttatgcttatcaaaccaccactattagatcattaattatcaaactactaataaatgttcagttttacaaattttatgttgagatgtttagtcctcgacatgagataatgtatatgtttgagaactcattatgatcaaattaaaatatttaatgggataagcaagttttgtgatgtcaatttattatattcatacccaaattttaagatcatgcaaatcaaattttaaataagtgaaatattttttattatgtaatgtcatagtcaatattttacttatatttttaaaaatatattatgcatttagttaaatttatctaatgatgtatctaataaatttaagattttataaaaaaataacttatttaattatatattataagcaattttaatttaacggttgaattgataaaatttaatgtgtaaaaattattgaatataacaacttgtaaaacaataatattaaaataacttgtagatttattgtccttttgcaaaaaaaaaaaaaaacaaaaaaattgcattaacttaatgaattttatgagaaaacaacctaagtgtatcaattttcatgtgattcacatttctgagattctaagttcaaaatttgcatgatttcacttaattatttaggttttaaaaatgtttgatggacaccataatgctatgcaacacctagtaattgaaagtaaaaggagaaaaaatatagatatggtagctagagtttatttggtaggaagagagagataaagaaaaataagcgatataaataaaaatgtttaaaataatgagtgtttatgtttcataaaagataaaagatgacaacacctaaagcaaaaaaaaaaaaaggctaagacttgcaagataaaccaacaacgaaaaatgtcacacttggtatatatcgtggtcagctacacatgatgccaccacgccaatcactacaatggtgcgcatgctgctgaattttgcgccaaagggaagccatgttagagctcgaccccagtggtttctacaaccccatgcctagcatttctaatacctaccattcttgcctattgaatttttttcttagttgctcatttgtgtctgttcttctctaatttttattgaataccaaaaactaaaatgtaattacttccttttttaatttctcaaacaaagatgtactcatacattctagtatatatattagttgtatgattgatacacttaattgtgtctttaacaccaataggtaacatattacatgttaatagttaattaacctcttatcatctcgcttaatgataattaaattccataataggtaacaaattatcatgttatctcatctaatctcttgtcatatatatgaacactaagaaaaaggcctataaagaagacttaattagcatcatataccaagtacgccttaaacactaaccactacgtcttaactcttactcttattgacttaaagcattagaggcatttacagttgtgaccttcctctcatcatatacctaactaaaaagatcacttataaagggcaccaacccttcaacgtactttcaacctgaaggtttgtgagagatttcctagctttgagccaataaaaaacaaataggatagaacttaattagaaatactttttgtcgttgttctcctcattaaaattataattttacttttataacctctataattaaattcggcattaaagataaataatgattattaaatacacctctaatttcaattgtagaatataaaaagaaataaacttaaaatgaattgaagccaaagttatgtatgtctgtctcgatatttcacgtacattgcaggtagattaattgtggccatatatcagtaaatgtttgaactttgaaagcaataaatactcgaaacaaatctagcctcctaatgcacgtggtttggcctacattcccatatcgttaactatgaaaactttttggctgaacgtggggtttgtcttcacttgttactacttaatgaattatgacatacagctaccttgtcagctgcgtaaactacatttttggtgaacactggatgagattgattggcatatatggcattaattcttgagtgtaatatacgcatttcttcaccatcgtaaatatacttcagtgctcagatactagctctaaccccacacccacctaaaaagaaagaaagaaagaaattaaaacacgtacaaaactctcaatcaattaattaatatacgccaacagaaaaatatattacatagtataatacaaaattaaacatttgcacgtaatccaataatatccaacatcagtgatgcacattagacaaccaatgtaaatttgcaggaaattaagaaagtgaaggctaagtgagtgagatatattgccgtcagtttcaattacatttctgtgttgcatattcaaaccgctggatccaggttgaaatgagagtgggcaaatgcacctcctcattttaataaaatcattaatatttgtccaaaaatattatattttatacttcctaattttatattttgcattccgtaatttcatgtatttgaattttattattagtgcatatgtaagagtaagtaaatgtatcctcttattttaataaaatgcacatatttatcttgaaattttatattttgtaccttttatcttcgtgtttaaactcaactatctcatatgataatgataattatcaatttttattttttaaaataaattgtccccactaacccagaatcctagatgcgtcatgacactgttttcaattcccattaatacaacaacaaaaaaattgagctgagatcaaataattaagtgacatataacaattactaatatataaatttttaattatgactaaaatcagatacctgtgctaagtgttgattatcgtactcaacaccagtgctgtcactttacagccgccacctcaatgctgtgcatggcttagcttttagcaagaagattctgctccaacggtggaaaatcttatatagcagattaattctttacataagattcccactaaatcctgggagtagttattctccctgacaaaatttcatatccatatatgttgaatggtggattggcaattggtgcatgtgggccacgttgatcttcttcaacatcagaaactttcacgaaccatttccctttggtttcaatttacacagcttttttcagaaaattaaagaaaaaaaagaattaaaaactttgacaaagcaaatgctgtgccagaacagagatcatttccgtgtactaattttctttctccttatagaattttaactttttcattttttatctactaatagttttacgttaccttcctttcaactttattttttatattaaattaacgtatttaaaagtcacattggaatatatatatatatatatatatatatataactatgtaatagacgtaaaatatttattagttttacttattaattactatatatttttcattgagaacctgactaattatttttaacaaatatctctttttaattacttttttattattcataagacataaatgtaagacccttacttaaggattaatatcaagtttcatcacaattaatatgttaatgttggtagattataattaatttgaattggatggatttatttaagctccttaacaattttttccacttgcaagactctatttgagatcttgttcacattacatatttcatatttgagtctttttattttaaaatgagatcagttttaagaaatgttttcctttttcattaatttacgtgactttatatttatattttcaaatactgttacttaaatttaatttaatttaaattttaagttttaatgcattgtaaattaaatatatattttttaaactaaaaggaattttaaaattatcatagtccctataaccgtaatttaaatttattttttaaatttaaagttatatataaaaaacatatttttttatatctttcttctaaattttaaaactactatatattttatttattttcataaaataaaataaaatatatattaataatattgaaattatttttaatttagaaatttcatttaaatttaaaatactcctataatatactaaaaatgtactaaaaaaatatatttgtaaccttatcaccctaatcacaaacatcagtatatcatatatatccttccctcttgatgatatggtaataaaaatgtatgctctaggatgaaaataagttaaagaaaaaacaaaaagaggaagacaagacaaaaaatggtcgtgtaattagggtcaaatgtgcatcataagtatttttttttacacaatttccaacacttgtattcatgtgtgttgttgaaacttcgactcttttgtctgtttcctcgagaatagcctgtctttatctgttcgccaccaattcaagggggctgtatataccatcgtttcttgtagtcttccttagaattttcaagcacatgttcttcaatacaacattttaacccgaagaggatctagaaaattattaaatgacacgaccacaatttaatcagagttaattttcaattaatgctccattaatagccaataatcaaatgtcactcgcgtttattaagttatatcattatcaaccttgatttgtgatgaatttggatatagggcgtggaactggtgtaaagcaaaaggattcgatttctccttgtatgtttggaaaatagaacccctgagtgccgttgtatgcatgagtgagcacgggtctacttggtttattgttttgggattgggtctactatggtgaatacatggctgcaatatttatgtgatttcttattggatcatgattgcagcatcacacttactatattgtgcttgtataacttttctggttgacacatcttatggcagcctgtttattaatattaaatactaaatttttttttataaaaaaataataatttatgattgaatgatagtataaaattatttaatgaaagaaatagtgaaggaaaaaattaatcatgagttgtgggcacttattgaaagggtaaatgttctttatgtcaagaggtgcgtgagcaatttgtataaatatggagaaaaaaaacatacaatttaaaatataaaaaaaaaagatgttgagaaaataattttttattagtttataatttattaacaaattttattgtagataacatgttttgcataataatataaattttcaataaaaaaatcaataaaagaaattatcaactttatttaatggtaatatactagtagttacaaatgaaacattaatttattataaataataatgaaaaaaaatactttttagtatactttttatgtatgaaattttaataatttttaaatatatttattaacatggaaattcatgtatcggggaaatatattgaaattattgcatgtaatatgtatttaagttaattatgtattacatttaattaataaagcatttaatattaatgtgaaattaattttaattatataatatgcttataaatttatcttattataactatcttatttttaagagtaaagtttgtaataactatcttttatgtaatattcttttaatatatttattatttattaacatgaaaaagtatatagcttagaaacatgtcataattaattaccatgtcatttaatagtttaatttaaattaattatatattacattgttaattttcatggaatatatattacattatttaataaacatagtatttaatattaatgtactgttaattatttatatgtgtatatatatatatatatatatatagagagacagagagagagagagagagagagataagatagtgttaaatataaatagaaaataataacaatatattaatatcatattacaatattttcatgttttctcgtattattagtttaatatgtatttattgacttccatcttattgaatttaaatattttattttaatttattatgtttatagttaatttctcaaaatttatgaattttcttcaaaaaaatatatattatatattcatgaattttttgtattataagattaagcatttgattaccttttatttcaacaagtttatacattataatatgctccaaataataatgaaaatgataagtttcttgatgaaactatattttcaggtatgaaattcttaattttcaattatgataataattttataaaaaatatttatcaatatgaaaatttattaatcaacataatatattataatagatgaatgtgtatgttatagtcaatgtattactgaagctaattatgcttgtatttaacaaatatagcatctaattttaatatcagttaagtttattaatataatatatttataaatttattttgttctaaaaaattaatgtatttagtatattttttagatattaattttaatataattaattttacaatgagaaaaatttaatatattttttcagatataaattttttataattacttttatgataaaaaggtttgaatatatttattaatatgaaaattaattaatttgaaaaatgatttataattaattaatgcaaaaatgaatattattatgtatgttaattatgtattacatttaataattttagtatttaatataggtatgtatttaattttcatgatacaatatgcttataaatataaaaaatctaattcaattacttaagcaacataagtaaattattataaatttattagtacttaagtttgatttttatggataaaaatgtttataagttaatttattctatacttcaagcaaggaagatttgaggttagagtcttataaataaataaaaatatgatgaaaaacatatatttactatgatgatcaatgaataaagattaatgatcattgaaattgatgaatatttcacagcattactctggtaacaaaaaatatagtaataataataaaattattttctatacatatgttattattaccatttaggattcttatttaaaagcaacaaaatgattaatttttaacaagttaactaaaattctaaaaaagttccgctatttatttgagtttttatttttattttcaaggactaatattttttttacgacaaggacatgttataattcactataattttaggatcaaatgactattcctcgtataaatatagatgcattagagattcacaacatatactcaactcaaatttatttatttttggactgtatactaaactcaattaatcatcacttatatggaaaaggttgtgaatgagtaggtgaaaaaataaaaaataaaaacaataatcttggtggactcatggaaagaaaaaaaaattatataatcatctaataataattttatgataaatgtgataatttttaaaataattatcttaaactaatttaaataataatttataattaaatgatagtataaaatgaattaaattattcgtgcatcaacattaactctaattgataatatgagttattagtaataaatgcgatataaataaaaataaaaggtagtaattgaattatttaaggtttagacggtcagaactcagaacagaggtgttgaaaataaaaaagatagtgggcatgtacatgtactacgttgtaaaaactaaaaagttaatcctgtgaggtaccagagttaaatacgtggacacctatcattcagtgtctcattctttccccttcagaaagaacgaacttgctctctctttgctttgctgtttctcctataatctctctgcaaacttgttcaggtaagccataatattatggattttgactcaccatcatatatattcagtcaattcaagttcttatggtatcagaattaattcaagctgactcatctctcatttcacaactcattttttctttgcatattccagcaagaaaccactttagaatcaatataaagttgggttatttcaagcttctgattccaggacagcaacaacaacaacataaaggtggttccttttatttttcctcaataaaataccaaatatcttattgtatcaaatataatcaccccctgtgatttatagttttggttcttaatttctcccctcaatttccaaattctcctttttgtcttttgcttaaaccagtgaaaattctagttcaataatttgagataattttcttcacatttgtgttatgtgactatgcaggaagtgattgatttgtgatggaagataaatatagtctaggcaggcagcatagtgggatatggaagtccttgagagatggagattttgatgaagaagaagtttgggatgttttcaagaacagaagtagtgattatggtacttctggggttcgcaagttcaaagacaaagatcaatcctcttctgttcctgttcctgttcctgttcctgctaggcctagttcagccagaatgatcccaagatctagcaatagcagcagtgctagttcctccaatgaagataaggttcttcagcaatcagcacctgtcaacattcctgactggtcaaagatttatagcactaaaccccccaagaatagtgctaattcaaggtttgatggtgattatgatggtgatgatgatggtgttgctaactatggtgggagtagtgatgaggatggagaggaaaatgatgacagtgataagcttcctccacatgagtttattgccagaaggcttgcaaggagtcagatatcctcattttctgttttagaaggtgctgggagaaccctcaaaggtagggatcttagcaaagtgaggaatgctgtactctcaaaaactggtttccttgaatcactataaaggggtctcttgagtagtgatgtagctttatggtaaaacataatcaattaatttttcatggtgtagctaaaaacaacaaatagtttcttctactttttttatggtatcacctgattatatggggtagaattgattcttatgtgttatccaaacatgatagtagtagctcttttacatttgggatgtatagtggggtttgtagttagaggttatttaggaatggatgttgtgttcatatgcttggggtatataaaagaattgtttagccatttaccatgaaaacaatgaatcaaattggttgtggcaatcataactggtttcatctccttctgttataacaaattcatgggatcagatgtgtggttttgagcatccatacaaacttaatggtgaatcataattatagagccataaaacattttgaaggatacaagtgtttttctattttactttgacactgattttttgttttcttttcccctttgttttccctgtgcacaagtccaactgtccaagccttggtctacttccctattcctttattactctgtattgaataaagattctgtgaggtgtatccatccacctttggatgaggaaagagtgataagaagtgatgggatagaaaataagaaatgtgatgagcgaaaacaacagatacaattatacaaagaaaaagaaggtggagaaggagttgttagaaaacagaagtatataaaaattattactctctacatcattgatgcgtgaatcattttttttctatgtttttaatgctattttttccccatttggatgctattacctaccgtattttttacaagaaacaagtgataatatattttagactattacttttttgttgtttttagtaaaaaggatcggatgtagtatagtattaagtgaaatcaaagtccatgacaaaattgaataacccttacacgagtcggaaaataatattagttatacaacttccacaaagttgtaatatacatagactgtttgcaattttctgagtccaataaaccaagggtttgccatttcacttaaaagttgaaatgagttactcgtttgtgtaaagctatatgagttgagaatttctaataaatgtggtataaactcgattagcctcaaataattgtttgttggtccaatttagaactacaagcatttataaatctttaaaataacgagacttcagaactctgtaagaagggtctaaattattcaatcatgttgtggggtgggaaattgacatagacattcaccaacttcgtgtcatctaataattatagactctcaatgtatagtatctaatgacgtgtgataatgcgagaagggaaggggaaacagaaacacccagtatgtaggagtccctatcaattttcagctttgatctccataagattaatttaatacaacctacgtctagtgtacgctttttgtagctcatttcaattttaaacgagttttatttttttcccaatcaattttttacctttattgtctgtttcgaatatccatgccaaaaaattattaaatgcaaatacactgattaagacctctttttttaaaattttaaatcagaaatacataactgataaaaaaaaggagaaatacttaaagaaataataaagttatctattgtgcacaattctagtagcattatagtacagtcaacctatcaagtatcaacttctttcacgacagattccgtgtttaatttagttctccaaatataaactacatgccactgtaggaggaacaaaaagtcaaatattaccaacaggatgttttcaacatatttttgaataaatttgaacaattattttagtgagacccaatatatgaaattaattcaatgataaaaaaaattaaaatatgtaactaacatatattctttattattgtaaaacattcatgtgtcttttgaatcaatgcaacctcatgtgagtttttgtatttaaactaaaaggggaaaaaaacttcaaaccttgccgtgacatataattcaaactgttttgtttattataaacattatattggtttttaataataaaaaaagttttcatatattatattgttttaatgattgcaatgattaaatgtaaactaaatggtaggattatgagtattgttttgattgatcaatttgtttcttgctttccaaatataccagtaccacaacataagggatatagaatgtacttgattaatctttgacacgtaaaataaaaatagcatcgtatttgtgtcctaaatcaaactagttaggtctagggacagagtaatagagtatgctgatttgtctcttgcaccagatgggacaacatacatagtagatagacagccatgcttcatagcgaaaatgtttgttatgaccaaaaaagcattatggaagaccttccctagaaaatgtctaaccttatatggggtgccttaattatgaagaggagctcattgatcttctcacttcacatgatatttgtttagcaacatgatagcttctcttaactaaataatccaaacttagaatggggtcgaatggctctaattcatctactatcatttaatacctaccttattctcgtttattatggttcaatgaccctacttaacaaactccttgccttgaagaatactatgtcaaacccatgaaacaaaaataatgaatttgggtctctataagccggccaattctactttgctagattagtaataccaccaaaggacaatatttgccaactattctagagcaatcctcttcctacccttattcctccatcagaacctagctactgaggaaattagaaaggtacaaaaagactaaggaaagtgtataacaggtattgcataagagggaatccctttgaaagacgaccttgattagagtttcctcttctccctaatccactgaagagtgttatttctagatctgccccattctgttgggagaccaagaaaattaccaacaatttcccaagcttcttttcctaagacactaataatatatatctcttttagtagcagtagaatatatttgccaaagattaatccagactttgctaagttaatcctttgacccgggacaggttaaaaatatggacagcttctccagcacaagtaatcccaaagataagagcataatcttcaaatagaaggtacgtaggaaagagttgggctagaaggggttcacaataaatctccatatgtaagagctttcttaataatcaattcatccttaaaatattactctcttctaaatactctattttttttataaaaaaaaaaaaaaaaaaaaaactactcaagtgatcccaaaagtataaaaagttgtgttaagtagttctccaaatattaaaaaataccttcaaaatagttcttaaactttgttaaaaatacattaacttaaattaaaagttatggttattcaatactttaaggattatttaaatgtttttcttaatttatggattatttaagggagacagtaatactttaaaaacgaaattaatgatttattctttctaaaatatttgagagagagtatttgaggcaagaataataaatgggcttgaggcctctgtaggactttggaacacatttagactgtatatgttatactagacaataaggccataactaacttagcccatttatccccagacccatatgctattagagccttctccaagaaagtccattctaatttctcataggctttactcacgtcaagctttagggctattctgtttgtgccttcgctgctcctcttcaaagcatgaaagtcctcatgtgctatgactattttgtcttgaattaatctggctcctacaaaggtactcagatatggagaaatcaattatgttatagaaccctaaacttaacagtaacacaataatctttacaataccttgaacattaaaattatggggactaatgtgtctaaagtgattacattcataagtctgtaatattaaccttccaaccatgccttactgtcacctttcaattggtgtaagcatacctatatctttggattgtagtagcatgaaagaaactcttgttattatctccccatttcagtcatttcaatctaaatctttacacacagtagtagttctacttccatagtcctcctttgattactctccatttcctcacaagttttattattatgggggtcatttcaaagaactgttagtctttgttagagtctagaaatctatagatttgcatttgaaaaaattgaagtctttatgtgccactgtagtaggtatttttgcagatttttttatttttcagttaactattccccagcatcttccttacccttcccttgtctctaccattttttcactaaggttccacaatgcttgtacttttcccataatgcctcgtatttaagttttggtaaaaatatactgttattatgtataaatactgtgaattcttgttttaatacttcaattttttattggttttaattcatataaatttttaaaaatttaaaatggtctctattatcatttattaatgacattggcataacatgtcataaaatagtcaccgaggtaacatgtcttcatacatgtcctgcaatcactaaataatgttagcgaccatttaaaaaatatataaaaatcaaatccaacaaaagttattttgaataactaaatctaaattttggtatattaactgagactatatatttaaattgtacttttttttatcacttctcatttttggaataaaatcaatgactaaggaaaagtgatcagaactcacacctaacgtagttgtcactatagttagagacctgtctagctttttctttgtagagaaaatatttctaggattattttgccttgtgtacttgtatcccttgggataggtttgtttgtatagaagagaaaagaatgaaagagaaatggaaaaaaaaatatttgaattaaaataaaaaataaatgtgagactcactattttttaattttttccccttatatagtaacctctcccccacacaatcaaaccatatcctttgaagttgtgtttgtcagcgacaagatagggacaatgagcaacgatggagtttttttaggtggttttatggagttgatttgtgagcaagatttaatttaattaattgggtgaaggtgcgttcctcctttgaaatttttgtccttggtaaggataaggtgtgtacatttatgtttgtgttttttttttttttgtcttttttatcaacaaaattgattcatttgattgaaaaaaaaaaagaaacatatattaataaggatatatcaatatttttcatatgacaagtattactgtaatgttgtgttaaggatgattacattaaacctttatttataacaaataaatatgatcagtattgattatattggataaatctaataatgactaataaagactaaatcactaattattatctgatcacaaataacagaacaatatgtaatcttaaaactctcccttaagctcgagcttgttataaatgtggtcaatttgataaaaactaaaggcgattcaagtatgtgattgtatcggataaacatgattcgatggcagcaacaaaggctcgcaatgacgatgaagaccactgtgatgcttgttggagatgtgttacgtgtcgtgtgcgtgatcatcatgcaccaagaccctatgtggggggcatgttgtggtgttttgaattggctatgcacatggatggcatggtggtctttggctaggtcgctagaaagagacaaagtgcgatgatgcgatcgctggattgtgggtcaaccaaacaacgacaaaacagagtcaaacaacaacgaaatagggttgtcggaagaagatgagaatgatggcatggtcaccacgctggaaaaggtgtcacatggctatttggccaactattagttaggtgtgtagatacaatagccaaagcaaccaaacaaatggaaatcgagccaaatgaagtaaaaataggtttttctagaaaagaagaagcatgatggggaggtcatcggaggatgggtcattcaaaaaacaacatcacatgttgattcggtgcaggcgcgtgagtgtcacgcatcagagggtggcgacatatgacagtgagatttgcgatgttgggttcgttggagggagacactttcgatcgtctaggtacaccaacgaaaatgcaacatagtggcaatgtaatagtgctcacaatagtcatgatattattcaagcgacaaaggggctgcgattgagaaaagagggaaaaaaacaaaatggaactaaaattgtttggttcgagacaatggcaagaatgaccgcttagaaaagtcattaggaaaggagaaatggtcattggaagatgggcaatgagcagaagatccaccggggacttgacagtaagtcatcgatggagcacgattttcactattctttgtgaagaataatctaaatttttataccatacaacagtattttactataatgttatgtgttaaggacgacaacactaacgatttatttataatgaacaaatataatcaatattgattacatataatcaatctaataataagtaggggtggaaataggccaggccaggctttgataggcctgagcctggcccgcatcacaatcattaagcctaagcctggcttgttacctgttaaacataagttattaaggcttgagcctgacctgcataagggcctggcctggcctgaaagcctgtatacaaagcctgattaaataaaaataaataattaaaaataaaaataacataatagatatgtttatctcataaattataaaatttcaaattcttataagttatagatatgtttctcttaattattttatgaaattttcaaggtacttttttgaagtggttgatcatccaccttcataataagaaaaaatatttttagaaaaataaatatattattttaagttttaatgtgtatatgtatatgtgtatatatatatatatatatatatatatatattaaataagccagcctgataggcctaataggctttttttaaagcttgagcctgacctttttatttaaacagacttttcaaaaagccttagcttggtctttatagtaaacaagccaggccaggccagaccaggccttaaataggccaggccaaagacccctgataagcagcctggcccacttccacccctaataataagtaatgaggactaaattactaattactatcttatcacaaataacaaaataatatgtaatcttaacattttattttcactcaatttatcatatatattttttaaaccaaacaacctaacaatactttgtttctctcctcacacaagcaaaaaagaacattagatctacctccatcatactatatgaagattggagtctcctccccactttctctatttctcatgttaaaagagaatggcattaaaatccctacataggaccaagctagcattttcagcatcaaattagatagacccagtactattccacaaaattctcctttgactaagtagggttgccataaataaaagcgcatgtattctacaaaatttctactcttattaaaaaaaaaaattaattattctgactactcttattaatttgaattagtacttgcatggatgaagttaagagaatgggtttcgacatcaactttgactttatacttacatggatgatgaatacatttttttgtataagggttggggtagctcttagtaccccttaatattaatacttttactgataaagaaaaacgtcgtctggttcaagttgagtttaggtaactaagtgtttcttcacgcttaacagaaataattaaaacacgcagttaatgggtttgtatttaattcactaaaaatagtattattacacacacacacatatatatatatatatatatatggatcagtttgaattttcaactgcataagcatgaatctcaaatagcattaataaaaatagagtcctgctatttagtgcaaaaaaaaaaacgcacgaatactcgtgcatattttgattattttctattggttaattggaagttatgaatggaaaaaataaattagtgcatgtggttgatgtaaaaacacggtgaatatttggtatattatttttcgtactaaaaagtattatccttgaaaataaattttacacattaaaatataattttaccatcagatttgaaacgcatgatcgtgcaattattctttatgaactgcacagttgatcatgttccgtacatatgtaaatggataataacccacttgagattccagatagattccttaaaactggtgggtagaaattaataaagaaaactagaaataatatgaagaacatgaacatctgtgtccatgaaaaattgcaattccttgagtgcaagctctctctcctcttccacatgtttttccttgaaccccatttctagcattcccctcatcatccccacatgaaatccaaattttctcaacctttcaatttggtcctcactcccacctcccaacatggcaccacacgcagccccacatgcatgcaacccaccgtcccttttctccaatacaacgcgttgcatgctttccacgtgttgcacctcctcaccaccgtccgattcaccctcccacaacgtttttttcacgtactgcgcgtcttgcaaccccaccgaccccaccgcacgtgatatctcaattatcacacgcaggactcgctccgggctcgcacgtgctggcccgtcgggcctcgccagcaactcaaacccgaacggaaccatcccgtccccggtgaggagttctatgttggggccgtacatgggcctggacccaggcccgtcggttagaggaaggtgttcatgggcgtgtgcattggcgaggttgagtaacaaggccgatgccgcggccatggcttgttggcggtgaccgccgacaagctcgcaggtggcgaggcatagggccgggacggtggtccggggggcggcgaaggcgaggtggaacatgggctcgaagacctcgaggggttctttggcgggaatggtttgtttgaggtgggcttcaatgtcggcctgcaaggaggcccagtgggggtattgggaagtgggcattctgagcggtgcgggcttgacgggtaaggggacacgggcttggcttgatatgcgtgagaaatgaatcttgaagttggcgttgaggagaagggctccaaccatattgagagagaaactaggaaagtaacaaaagtgaggaagtggtgttgaaatgaatgaaggtatttatgggagaaagaggaagcgttgggagtgtgaatgaagtccaaggatggagggtgttatgttatgtactaggaatgcaatttgagaagcctagttgcttgatatgtagatgtgagaggtggacctgactgcattaatgggcacaagaactaggcttaaatagatagggaaaactaggctgctatttttattattttttttgtgaaattgagctagctgctaactttatgttggttaaagcaggtttaagttcatcaattagtttagttgagaaaaaactagaaagttatatttttttttataaaggaagaaaaagttagatataatttcttataaaatcaaattgaatcttatataattttttgatggattttaatgtgtcacataaaattaaaaaactttaagatttttttcatttttctattagtggtagatctcatcttagataacttttaatctgtcctatatctcatttttaaatattttatataaatatttattaaattgaatataattaattaagtaattaaatttaattaataaaatatgtaagaattttttataaatattaagaaatagaaaaataagcataaatttattttttatttatgactaaatgttaaaaaaaataatacataaatttgataataaaaaatataacacattaatgccaaaaaaaaattattattgttatgattgtaacattcttaaatatgctctatcaagtatgtttgaagttgttgatcaattatttttatacacataacgtgtcttgtttgcaagtatgtagtaaaatcaggagagtaccacgagatgttttaaaatttaaaatgtcattgtctatgtgataataatcaacatcaatattatcactaaatgtatctcgttcgtcatcgacaatcatgttatgtaatataatgcatgccaaaattatatttttcattatatccatgttccaggcatgcgatgaaccacatataatcacgaattgagattagaggacaccaaatactcgttccacatccttaagatctatccccaagatcttaagatttatcctcaagatccaatattaaagatattcttagatattaatattatctaatgttaattgagtcttaaaagtggttaacattatcacatggataattataaataattatattaatttactcttactcacttttgaattaaaaatgtatatagtttaccatatatataagtagaaattaagtaaaaaaatttccagatatacaataattcttattctattaaacaattaaaattaagaatttgaaactataaatttattacttgtaaaaaaaattatactattaatcattaagaaactatactacgtatgaatattaaaaaaattattgtaaaattaattaatatctttttatactattagtacataggctatttattttaaaattaaaatgaataaataatttgtaacatttatatttttttaaaatattttttcaaaatttcttttatttaatatttttattttaaacggatcaaaataggatttaatctttgtaacttcaaatcaaccattttttgttttcaaaatttgaaaaatatgcagaattagtccttttcctttaacaatgttaatgctgttaaggagctaaatttacatattttttaaatgttgaagatcaaaataatcaatttgaaaattaatacagaacctaaaactaattttaaataaaaatacaagaacgaaaaatagattttacccgcatttttatttaactcacccacgcaagtgggattggctcactacgttacttaaagtatagcacaccacacatataaaatggagtagttatgtgagttttgtccctagtcaatgcttaccaattatcaaacgttaaagtggagacatagacctgccacaaaaaaaaaaaaaaaaattatttacctaaatggcatgcgaccaaaaagttttaccatgcgatataattcgcttgtcagtccaacgaaatacgtgatagacacgtgacagtcagagagtaattcattggggagcccagtgaattaggtggacacttggcaaacagagagtaattcgctggggagatcaacgaattacgtagtaatagaaaaaaatctcaaaaatttcgaacggtcataaattttgatagaaatattcgatggaggcgtataatatgtcaaaatgctcgaaattcagaggcgagcattttgacgtattgtatacctccatcgaatatttctatcaaaagttaaatcatttgaaggacatattgcacttagacgcattttttgaaaaaaaatagtggaccaaaatccccttcccttcgcctctaaattttgagcgttttgacatatcatacgcctccatcggacatttctatcaaaagttatgaccgttcgaagtttttgagatttttccattgccaggtaattcgctgggctccccaatgaattacttcctgtctgccacgtgtctacctaattcgttgggctcgaattactccctgactgctagtgttcatcacgtatttcactgacaagtgaattataccacgtgacagttgataaaactttctgatcgtgtgacatttagataaataatatttttttttgtccggacggtcgatgtctccgttaaagtgttacctaaagactaaaaagttccgtttaagtattagacacaaataattattttattttcaacgtgtttcgcgagtttgaagtgtaatctataaatttatttttcttacattaaaatttaacttttcgtaaaaggataaaatcatggcaacagaaaataaactttaaattacttaatcataaaagtttttatactgtgtcatgaattattggaagaaaaaacaaaactaaagcaagtccagtgaaatgaaactgagtttatctttcgagtcataaattcaaactctcacttgttatcttaaagtaaagtaaatgtaattttttctatgaatgctccttgggcctagaattttttgtttactgtgaattgaagtaatgtcgtcttcactgcaatcttttataagaaaataaaggaattatttcaaagttttatattgttaaacaaaaatacataaatatgtttatattacgttcgaatcagaatgaacctgattctttttaaaacggagagtttcatttttactaactggaatgggaattcatatgaaaagcataatctttttacttaaaatgagaatattttaagtgttacataaaaaagtaactaatctcttcacgaatgatctaaaaaatttatattatcatttatttacaatgtcgattatatgtattattatatgataatcttattaacttttagaaaacatatcgttgtaaaaaaaattaaaaacatatcaaccataattttgtaccctttttgaatttttaatatcatttatatgaattagcatacatatattaacataaataaaggattaataaaaaatgaaaaaatgattagaaacatcaaaatacacaaagaatcagtaatgtatatttttaaaaatatccaaaaaatatttatatttatgtataatagaaaaagaatactaattagggtattaattaataatagaaatattttatactaacattacataaaaattaaactctataaaatgacgctttattacacctaagtagactggacactggacagttgcaaatgcccagttgacaaaagcctaactaatttaattacgagttacgacaattctatgtttggttttgccgattgtaacaaaccaaacttacttttgaaatatttaatactttatgagtttaatctgtattatatatcatcactaatactactgtataattttgttcataacaaacaatgagaatttcttttaagagacacaatcaattgaacttattaatacatattagaagataacgaattagaaataagatctgtttagatacaaattataaatatttttttaaagaaaattattcaaaatatagaattttttctaataaaaaaactttaaaaaatatttctaactttatatttaaacagactataatcctcatctcaccttgatcaaattttttaacacaaacaatttttgtgaattctaagtttctaacccaattcaattaaaactagacaaatatatatggaatagacttggataaacttaatttgtttacatgatatattaatattattaacgttacatataattattttgtagaattaaagaagtatataattataattaaaatatatttataatattatttttaaaataaatattataaatataatattatatcaaacaaaatattatttatttgtcaaggagttgtattatcaatatataattattttttaaatattatactttaaaaaatgacattgtagtaggttgaaatgacctaaaatataagtctaaatccatccttaaagcaaatttatctaatttctttaacttgaactcgttaaaaaaatcctttaagaacagattaagttagtaagatgagttaggtcatgaacaccctatttcatattattccaaatactctgtttaaataagttgtctccaatgatgagttgacaaatacctataatttatatataaaaaatactaatacatttacataatatttttgcaatgaatcaaaatatttatattttaataatttcaaatcacccttttaaaaatctttatataattatatatatacttaatcattttaactgctagtctatttcaatataccatttttgtaatccttatttttaaattatattttaacagtttttttctaaaaaaacataacaatagttaaaaaaataactttatattataatttaattttttattataaatttaaacataaattatatatatttaaaaattataaattttaatataatatatttatatattgaaaagtattagtttgttataattttttattatataaaaataaaaatgtactgtataccatagtaaccatactacttatttttttaaaaaaatgataaattaaaattaatacagaaaataataaatttttccaaaggaggtaacaagtaaagtgagagtaagttgtgatacagtcagtaaaattatatcttgatgacttattgatcataaatttaaatctgaaaatagttgtttgtatatgaatggataaagtgacttacaattttcctcccccttccatgtgcgagagcctcctaagttttttttttggtcgcaagtaaagtcggcttcgtttatttcagaagacaagaaagagagagagattagaataagttggtacaccgtcaaatttggttcctcagaattgaggtattgtgtaagggcacgttctgttacatcgtttttcattttgattttggatggataaaggtaaaggtgccaaggcattagcgacctctttgcaaaacctcgatttgaatcctccatccaacgtcaaatccaagtcttccatttcactcacccaccctcaatttcccggtattttttaaacccctttttctctctttcaatctgcttttgtattttagagatggggtgttatgtttatgtttggtttttggtaaagctttcacctttcattgacccatgatcaattgcacttgctctgttttggggatcaattgaaattgaaagaccgttgacaaaacaatactaactctgaaatgcagtggttctttgtttctgtgataattttaggtagaaaacttcaaaaacaaacaaaaaacacttcaaccctcatttgggccttttactgcaattggtttcagttttgatcatattgcctggttttgtggcaagtgctcattgtttaatttggttttgcccttagactctgtgtttgtatgactagattatgctgacaattgaagctcagtttgagttttgcccctgaatagaatgactaaaatttgttttctttgaaggagacactaggtgggtgttagttgtgagaggttttggtagtttaaatgagatcttagggtttaaaccttggtggcacgatgcaccaattattttttcataagcatgtgccacatgataggcattaacaaattatttgagaaatttttgtgcaggattactgcctaagaaggcgaagcctccgagtttagtcagtctttgcgttggagttcttggaagacatttggaggatattgttgcagatttgagtgaaattgctatcaacttgccagctgatataaaggtaggttgctagagaatgattctgattcttcaaatcctttaataagtcatttatcctaatgctcatatttgtcaacaagtgaaattctaaatttatggtgttctcaatgtaaatgtgtgggaaaaaaagatttctccaggatttcccgctttctttgctaaagaaatatcctttgttgaggcacccggttaatattcttaagtggttgaaacttgtgttccgctcactgttctaaacacttctttgtttatcccttgttaaaaatctttgattataatgtatcttcccccaaaaaagaacaaaaagaatccttcatcctgcagcatgtattttatacatacatacaatacaaataaaaaagttagttatgcttaatgacagatagcagtggcagctattgctagaagaagaaaattgctgaatgatgatatcctgatcgcattagctgatacttcctgggaaatccttgatgtctctggctcagatgtctctgattttggcttgattaaagcagctgaagtatgtagattcattaaagctctagatataaggtatagaactataactttttttattaaaaaaatgaaacaattactatgctttaattgtaatgcaattgatctttgatgtctgagaaatgggaataaataagctgaaaaaacaagaattatcataatatttagtcttttcatgtatattcaaatttcagaagacatttcatgcaatatgctctagcttgtagtcttaactctgtagcttacttgatgctacaagagcatgtcatatgtcccattcaatggaccagctggtaggcacattttgagaaaatattttgctgtttgaactatatcatgagtttattagaagtgagtgatgaatgcagattgagttttatgcttagatcatcctcttccattgtaattttaattgtatttcatggttttacttctactggatgtggttattattaattttcttcacctagtttttggtccgtcaacaacttgccttgaggttagcatattgtaggattgatgtgatgctaacaatcatttttttagttttgtagtgtgtgtttttatattatacttctctctctttcagaatcacttgatatattgagactatttgcagccggtgcaccaaaattactgctaatggtatatccgagcttgtgaagcactgccacttattggagacattgagatgcgggtacatatcctgtgctatccactttaagttttatttctttgttaatgcaatttgttcattgtgttgttttagactgtattttgtctatcatttaagacataatctgaaaacttgtaattttgcttcaatgggccctttaggtaccatgttcttgttactattgtatctgtcatacttttgtcgttaggatctgtaaattgagttctcttgtaaagatgatcaaaacatatttacttactcatttatttataatgccaaaaactggctttgatataaaaaattgatgtatattctcacgaaggaaatgttatccgaaacttgggaagttgtaggtattgggaaatttattctatatttattctctcttttgttttaaaaatcaaattaaatcaaaaaggtagaaaattatgtaattttaaaattgtttagggtgctttttttttttttttttttttgttttcatggtagtaatttcctctttattacacaatgatttttgtctaataaatcacattggatacaagactgtgttttgactaggattacatcattacaaaactcataacaggcaatgaaccataattaatattgcagaggatgtccaaggagtgacaacactgcacgaagatgcttgggtatatttaaaccaaggtttgatgattatgtggaggaggattcttgggaggagcttgatacaaaagaaattgctagtggggcacaatcactcaggtggcttgtgtgggtatgaacttgaaaacttctgtctaatttgtaattgaatgcaatttttgtccttactgaaatgcaaaaattcatgtatttccttcttagtttgatgtctttgtttttatgatagcattggttggtgtagagacacataggctgcacttcgtccagccaatgggggatggagtgagaattaggaaaaaataggcatgatggataacgatttttctttgattctcattgcatatagaaaatagaagttgctagtagtttaatattttttcatggccgacatttcttcaagaagtgattattttattttatttgcagccaaacattgataaaaattctttagaggacttttccactgagtgcccacgtgttgtagtaaatcctaagtcatcaccctttgggtttaagggaactgaggttcctcgggaagcattacaaaatatcatattggatgatgaagttgtcaaggacattgatcccagaacatggacaatgcatgggtttgcattgaagcccatctctccatcttcaagttccactgaattatcagtagctgaaaaattcagacttgcatttgtggaaagggacaaccgattagctccgaagcgagctaaaaatgcccggcaacatcagcgtcgtgcagtgagggaattgatgctgatgagcacaagagccaaggcaatggtcttagcctcacaagcaagcaagtcccttcatggccgaagctcatagaattctcacatgacatgcatttttcagttgctccaaaatgtactagtagtattaacttcttctgtatttagtaagaagttgttggtcatacagattttgaatctttagatatctcctttgacaagtcagaaagatcagggctttcaatttgtgccttgtttgaggtttctcacgaaatgaaaaattgttcagttgcccatgttatggaagaaatatgattgcctgttgctttgttccatttattgtggaaatgtaaaattaattttccaacatcattgctttggaagaagctcttgattcaaaaggataaaggattccttctgcatgatatttggccggaagttattgatgtggtactgctacctaacggtgcttctgctgagaggggccttgttttgtggaatggtgtgatgcatgtcaaaactgcttataatcgactgttatgagaatggttgatgagaaaaaggacagtgtctggcaatttataccctgttttgaaatatctcaaacggagaagacacaaattttctaaagcaaaaattttagctgcaactaaaattttgatttgagtcagatgcaaacaggctttaagctacaattattgtgcatgtttgaggcaaaagtcattttgccaacgcatcaggatccttgtttttgcatttattttgtttttatctgtgtgagttggagcttcttaaattcattttcaataaactttttgatttcttataattgattttagcttgtgtttggacacttttgtaatgcaaaagaacatgtcaatttgtttgaaaagctgttttgagtccttttttattctttgcattaatggtattatgtaacgattttttatcatcaattttttaatttaatttctttaaaaaagatttgtgatattttaaatagttaagatattttaaaaattgtcacaatttcacattcatattttttttttcttctttaaaatcatcaaaatatgtaaaaaatgtcagcaaatcatattactagtcaaatattttggcatttaaaattgtcataaattactttttataaaattaaaaaaataaattttgatgattaaaaattgtaacaaatgaaaccatgaaatgataaacaaggagggactaaacttaattttttgaaaatttgagggactaatgaaaacaaacaaaaattgaaggactaaaaaaatgtttatgcctaaaaaatataaattatttatattaaataatttgtattagaaaattaactatatatagaaaaaaatgaaaaactaaaatttaataacttctaatagtaaatactactagtagtattaaactttaatttataataaaattgtcaattttatattttcacaatcataacaatttgttgaaaaaacatctaaaaaaaggtttttgttctttgaaaataaattatatatacatagcaagataattatcttttataataaatgctaaaaattgtaattaaaattatttgtgattaattaataaattaaactcaatataattttgttgaaatgtttgagtggagtagtctgagttgggttgagctgctgccacaacacaatctcatacagcgcaggaatagaaggaaaagatagagaaatgtggaagagaaccttggtcggtgccgtgggtgctctccggcggccatattcgtcgggaggtggcggcatctcctccgccgtgaactcaatgctcctccgctctctaaaggatcactatcaagaagtcgccaaaatgaacatgccccctgtaagctctctctcactctgttatgtgctagggttttactttaggtttagacattgactaactcacgtgagagtggcacgtgcctagcagaaagtgagtcctccgtcgccgttcacgatcgtgaagggagctctggactcgcacggtccggttctgaagcgcagctacggcgacgaagaggtcagcatctatgtcatgcggttgttgacccccgaagacgaggattccgccatcgaccagctcttcatccacgtcgacgtctccaaacctcagcagaacgaatccttgattttcctctgcggtttgtacgaggatgctctggggattcactctgtttccatgaggcccaaggtccaggactccggctacctcctcatcccctcccaatacaccggccctgttttcgcgtcagttctgtgctctttgctctcaatttttctttgtttagggtttatgcttgtgtagtgtaggtctggagattggtaattaaattaagaagaagaaaaaaagtatgcactcatagtgtaaaatcatccaatcacacatcacggatagtaggtttgttgatttttacaaaactatatactgtccgtgcatcactgttaaattcttaaattaatgtcattgcaatctctagagtatatgaaagtataaggtggaaaaagatatatcaaacatggacggagattccacgtttactggtgatatgatttaagtggggaacaacacttaccgcatgagttagcttttgaagttctaagatggcattggaatcctagtggttgttgttggatttattagactactcgttatcaggtgttgttattggatcacctacaaatattcaatcttgcaagctataagttgtgtgtaatttccggggtaagcatgtctcttggagatttcacgttaactagtgatatatgaccaaaatagtatatatataggtggggaatcacttctctctaagttagattttgagattgaattaagttcaaaacccaaattcttagaaaaccgagttctatatttaggtataaaatgcagattttgggaagaagcatttaatttttttgtagatattaggaatttaggattaaaagaatggagatgaagtagaatgccctccactcagaactcttcaattgctgtaaggagtagtggtgtattggctctttttatttattatagtaataactattattgaaaatatctctaccgtgcgagttacttcatttcattttggaactcaattgtgagtgtttaattaaagtcaatgtcaatgtgatgtgattgattcattttgatgctctttccctgagaaaagataggctggacttagagaagaaactgcggaattgtgttttgcattttgggagaagaaaaaatttcttacttttggaagatacgaatacgcgtgttgtcctagaatgcccgttttgtgttttatcatatacctgttaaacttcgcttggaaattcttatgttttttgctgactgacttttctgtaaatgacagagaactagatgaaaagatgagagatgcgtttcacagttacattgaggagcgaggagtgaacgagagcctctttaaatttcttcaagcgtggctatatgtgaaggaacatcgaaatctgatgcggtggttcaaaaccatgggcttgttcattgatggaaagaagccagctacaggtgcataaccctccgagagatcaagttatgaattcaaaacttgcaagtttttcaatttaaaagtacctaaagtttcatagtttactattaggatatttattttggaggatcaacgcacccacataagtacataactttaaagcgagtggtaaattttatcaatttaactctttgtgatatgtgatgtgattatgacaaatatacacacaaaatttaagatgattttttttttttaagtatcaaaatgcaatgtttgatattacattttaaaatattttatgtgacatcaaataaccaaatagtacaccaaattaaaaataagccaactataattagtaatgttcatgacttatctgtctcactaactttacccgtagttattaatgattgaactttctgacataatttaatacacaatgttttacctaaattatatttttttacttatttatttttaaaatatattataaatatattttaattgtaattatatattttttatcaagtttgtgatttaattatatataatataaaaattgatgtcattgtcatgttaacaaatcagacaatttcaatcttattctatatattgttaggtctagattaggttggaacttaattcaaatgaaaaattctattaaaatttcatgttgggtagaatcaataacattcaggcactagttaaaagggattgggagattattattcagcacgttcattgtgcgggtaacctatgtgttattctactgataaaaaaaaaaaaaaaaaaaaaaaaaaccaatgtgttatttagttttctggccaagcaaggatctaatgaactttttatgaattttgtgtgtgtgcaatagcgacagaaaaaaaaaaatccaatagtgtgtttggatctgctcttaaaatccacattttcctacaaatccacgtcaaaatctttaaattgttggagaatctagtatttttagtataaggttacgcatgtttactggtgttaacacccaaccaaacatgcatgcagtagatctttctacatttattctaatatctcactattaggcccaggggtagccacagtgtggttttagatgattttttcatctaaaccagtcgattttgttttcatttagttttgcttaatttttattataactcgaaccaaatcagcttggatcaggttgccggttttaaaaaaaaaaaaaacagattgttcaaaaaaaattaaaagaaaaataatgtataagcaaattagtcttaatgtatgtggagtacaaatggagtttggcttttcaaatgccgaatttccaacgtgtatttttttctttaaaaaataaatacctaatttaattaggtttattttaataactaaatgtattataattaatttttttaaacaattgattagtttatgttttaaaatgtgttagaattgtgaatttaggttaaaatgatgcattattattagtataaaataaaagatcaaattgtatttttttagtgtacaatatttttttaaagtcataggtaaaatattatatagttgtcaatatgataaggacatttttttcttaatatgacttttcatttcaacggagtccacatcttttggatatttccgcatttttggaaaaaatgtactcatttaaaatttcaatatttcccaactctgttactactactagtactacttcttcaacaccatatatggtgcaacaagatgaggcagccatcaatgatcaagaacaacaatggcaatgtagacaacatcctcaactcgtatataacaagcttcctccacaatgtgaggcctgtcaccatttaggatattgattttgatatagtatttatttttaattctgttgtgggaccaatcaatattaatttttatattatttataaatatataattttaatcaagatattagtttttaaggctttctgaaatacaatttgatcattttttataattaaaatgcatgcttttaatacaaaatcttaaatcttaattctaacacattttaaacccctaaaataattgaaataaaaaaattaattataatatatttaattatttaaacaaattattttaatacaactaaattaaattaatgtttaaaatgaaataaaataaaagcatgttcatttgaaaagccgaactctattgataaagcatatacaattaagaagaattaaataagttgctaagtgatctaaaaatacaataattagttgctaagtgattctaaaaatacaataatttgttgctcagaggaactaaaaatagacatcaaaatgacaaaaaattaactccataaagactaatcatgataaacaaataactaaaaataagaaaaaattatatgaattaaaactcgaaatttgaaatactataacaccaaaatcttatttaacccgatttagaatgttgagatttcggtgaatcaaaagtcaatttgggtaccaaaaaattgccaattacctactctgaatattaataaaaaaaaagtattttggtacatattttgggatgggtgtttgggtaaataattttttatgattattaaaacataaaagtcacgcttcgtatttttttaatttttttttaactaattcaagatgttatatcttttctccattttaaagaatttgaataatttctaaaaatattttcaattgaagtttatgaatagttcctctaaatcaaaagaaatcattgggtaagtctattttatttagttatataatttaatttatatttatgttttacaaatttagtatttaaatatatcttggcaaagctagagcatatgtgagcattttgaataaatatttcaaaatttaaatctatgagcattttatattagtattttgattatttagagttacacacatgaatacttgttatttttgggtaaagaagacatgttcttgaatgcttatgcttaacattgccattgtgtataggtataaaatagcaacaaataaacaacgatatcattcaataataagtactacgaatcactgaactctttcagcattattctatgttttccaacaaaaacagagagaaaaaaagactcctaaagcaattgaggttttgaaaatggttgtgacatcataatgaatataaatcaaatgctttgtatcaattggaaatggtagttttaactaaaccaaggaacttgactttcccattgaaattctgctgtgctgctgctttgtgctggcaagacatcaaagtttggttcagcttcaattgttgacaagacattgaagtttgattcagcttttgcctgtgggacttgaagcttttgacaagtaatttgagtttggacatgggcaagtgcaatttctgtactgttgatttgttcatataatttagagataatcccagcacatccataaacagggtcttgagtcctacattgtgcttcaaaatacaaagaatttgcagcttgttcacgtaagtatgatggaatatgctgcaacatcaaaatatacaaaggttatttagtaacataatcttattgactttggatgacatattctaactttgatatattgataattttttccatattatagactaacataaacacattgatatcaaatattattatctatatttaaaacacctgaagcatttttccaacattgctgccaccatagattctgtgaacacaagcaaatctttcaggatcattggcaggaaaatatggaaagaaaatgcaatctgaagggcattttcttctttgattcttgcaagctgcacacctaccagacatcgtgatatcaaatatataaacaaaaagaaaggaaatcaaaggaaaatatttggcatccaagaaagatttcttctcttctatattttgctcgtgtgagagggtggatatcttacataagatttgatgttttagttgccaagagtatttgtatagtagtagagttattaacggctactttttcaatattgcaatgcaaaaggaaagtttttaacaaaagagaaaggaccatgaatcaagacacttagtctatatcacatgaaaattaaaggaaacaagtaatatataacacatatatagaagctaagtaatcaaatacttctaatgtttttgtaaaatatacaccaaataacaaattcgtgtcaaataattactttattattttattttattttcatctcgaatggaaaaataatttttgaataacattatatttttattttgtacttattatattttttaattttccattcaagtgaattaatttttttatccaaatatatctctttgttatttcatatagtgtagcatataaacaattatataaaatttataatatctttgctattaattgttaatttaagtatttgtaataaataaacttcaacttaatatattatatacataaaaaatacagtatgtaaaaattaatttgataaaattaattgttaacaagtaaaatttgaaataactttatgattatgttaatatgaattttaatgttggtatactaaaatatgttttatagaaaaaattaaaacataaggacatattaaatgcataaataatttgaaaataattcatcataattagttgctaagtgcttctaaaaatacaataattagttgctcagaggaactaaaaatagacatcaaaacggcaaaaatttaactccataactaaaaataaggaaaaattataggaattaaaactcgaaatttgaaattctataatgacaaaatcttatttaacccaatttagaatgttgagatttcggtgaatcaaaagtcaatttgggaacggaaaaaatagccaattacctagctactctgaataataataagaaagagtattttggtacatattttgggatgggtgtttgggtaaataattttttatgattattaaaacataaaagtcacgcttcgtattttattttttcaaactttttaactaattcaagatgttatatttttctccattttaaaagaatttgaataatttctaaaaaaaatcaattgaagtttatgaatagtttctctaaatcaaaagaaatcattgagtaagtctattttatttagttatataatttaatttatatttatgttttacaaatttagtatttaaatatcttggcaaagctagagcatatgtgagcattttgaataaatatttcaaaattgaaatctatgagcattttatattagtattttgattatttaaagagttacacacatgaatacttgttatttttgggtaaagaagacatgttcttgaatgcttatgcttaacattgcgattgtgtttaaggtataaaatagcaacaaataaacaacgatattattcaataataagtactacgtacgaatcactgaactctttcagcattattctatgttttccaacaaacacagaaagaaaaaaaagactcctaaagcaattgaggttttgaaaatggctgtgacatcaaagtaattaattaaaacgtttaaatatattttctaaattaatgttttaaattttttaagtaattaacaaaaattcttcacgctataaaagaaaagtctatttatctaaataattatataaaattactttaacaacaataaatactatactaatatttttatgaaatttaatttacttatatttattttccaattttcagatgttatattaacatgtaaatcaatatttaacatctgtaaaattatatcaatataatatatatatatatatatatacgtacatttataaaattactttatactatcaaatgtttaattgcatgctgtaaataatttgtcctaaaaaatttcactgctataaattgcttattctgttttgcacaccccgctactatatataccccaccactacctattcttctcaattcgctctttttttgtttacaagtcctcctttctcacagattcgtctctccttcaacattagatcttcctagctcatgtttaattcctacttggtctaaaaaattgtgtttgtgaaagtttgagttccaagtttgatgtctctattacacaagaaaaacattttcttttcttttttttcctactttccctacgaattatatgtacttgcatgatgtaaaagaaagattttgttttaatccataaggttgatatagagatgtaatgcttcattgcgttcatatatggaaaaatgatgtatttagtgaaaaaattatattcgatgcaaaaaaaaaattgaatattttattcaacatgcatatatatctcaaacaacgttgtcactggttgaggttgttgctccaaatcatctggtgtcaccatcggctggaaaacatgcccaattacctaccatagtcacaaatgacaaagcaactttcatcatattgaattatacaaagaatttaaaaattttccactattgcaattaatcatgatgataattaattataagttttattaatgattaataataacggttttaaattgcaattgcaatcaattcattaggttagaaactaatctcactcgtgatgcgtttatatatgaaaaaatgatgtatttagtggaaaaattgtattcgatgcaaaacaaaattgaattagtaaccattacacaccatgagtgagattagtttctaatctaatgaattgattgcaattgcaatttaaaacctttattattaatcattaataaaacttataattaattatcatcatgattagttgatagcaacgaaatctaacaagtatttgagataaatatgattcattatcatcgtgatggattgataaacgtatgcaaggacctttgatgccttcactaatctggcatgcaccacagggcacagggtaattgtcttcggcaatagcatccacaaagcattccaattgctgaacaaggggaggggcattgtggcgaacgcagtggcctggtgacggtgttgtttgtttataagatatattttatgaaattaataacatattcagataaaaaaatttaatttacttgaatagaacattaaaaaataatttggattctcagttacggagccattgatggtgatggatttaggagggcagacagtggtaccctatacacaggcaattaggttgtgataccatatagaagaaaagaaagatctgaatttattgatgtataagtgaagtacgagtcagtttaatttgttacataaacaactaaaggatatatataacattgttatgcaacagagttattgtttgaacttaaagacaaatgcatagagtttattttttggatcaaagataaactgaagtgcttgtagatattcagagatctagggagagctagttccaacaaacttcacctcacatcccttcatttcttgaatctttaatttcttcacatggccttgtaattcttggaatctccaacattattattagcactgctattgcaagcacctttggtggacgtgccttcttcttctctctttctttcttcttctctctttctttggtcttgtcttctgaggatgctattcaaaatctcagtgtcgtcatcctggaggaatgaaaataagtgaggattcttttgttgttccagtgtaagccaggcacggatacccttcctcaaaaatatatcaaccgaatcaccttctttctttacagctcctcccgaattcttttcctcatttgccattcttatgtatctacgttgcatattagagtttcatttctctactctctctgtacctatatatgagtatacacaaacctaacaaattttacaactaatcaaatatactaatttaaaaaatcaaagcggaaaaactggaatattaccaaatcatccgcagtatatatatattttgatgcgaaattgtcaaataaatttatatttatattttttctttttttataatcttctacctaatttttttgctgaattgcagtaaaaaaaaatattagtgaaaataagtatgcctatatgtcataaagcattccagttgtcaaacaaggggaggggcattctaggtgcgcagcaacatgagcccgtaggagagagacttggcctggttggaaatcaaggtaagtgctgtaaaaatgactaatattaatacgatcttaaagatatacaatttattacttgttaacaattaattttatcaaattaaatttttacatatggtatttttaacccttaaaataggtccttttatttttaacttaaattagtttaaagttaatggggtttgcttatatagatccactaaaaatattagaagatgatacatgttactactaaaacactttttctgttgaaaaaaaaaaaaattcatgttttatttacaccaacataaattaattaaaggcgggatcatactaactttgaaattgagtcttcatttggagtggaagcttcaactctatatcctgatatgaaatacaccatgtagtttagtaccttaatcagtttaattgtctgggaaacagtcctagttgattttgttttcttggtggaatttgttttctgaataaatggaatcatgtaataacgtggacttgttgggttgtgctcctcaaaggaaccaatatagaaactatgtataagtattctatgataatttttgtacgtgcttgttgatgccatcaattttaattttattttccttatatgaattcagcgtgaaaaaataaatttggatatgtaataaaaaaaaattgaatgagaagggcaacatgttttgcttgatattctcacccagtaatagataatataaaatttatacgttgatatttggttttaccgtcaatagattaggcctttaccgtggtaaatgctttaccgaccttggaagcgcttgcctaaatccaattgccgccaaaactgaattttggtcggttttatcaagaaaagtttattttttactagttgaattcggttcagtttatcatcaattcggggttcttttttttgcctagccctacttataggttattgtgttgttactcattttgacctgaagttaaggagatatcgatcttcatgatctgggagctagctaacagaaggaatggtttgaaaggtcttgaaactaatcaagttttgattgaatttgtcttgtatgtcgttggtctaattgttctcaagttaatgttgatcaaacttccgttaacacataatttcatgatatccttaaaatacatacatctgcaatgaattaagaaattatagcttgctaatatttccttacgtatttctcttcctatgtccaaattttattatctgcataatatgtatatgaccatgaaacctgcacagttagcaaacttggtctttatattatgaaaggctaataatcgaaagttagcaaatcacagataaaacaaatctgtcatacctctaaatgcagcacactttacaactctgaattcagcttctaacattatatttttaaccttttcaataatttattgactagaataagtataaagaacatgaataatttcaaaaattagaataaaactagtttaataactaaaactgaataacagaaacggtaaacaaaatataacctcccaaagtaactaaatctaatttgaagattatattttgaaatcatgatcctgccacggatgtattcacaacttgattcttaactagtgcaaaacagagcttagaggagagtctgaaggaccaaagatgcagcgtatcaccaagttttagatcattgtgacacacaatctcgttccatcccttggtcaagttgtagacgtagcttctctccatttcccacttcttgaagcacatgttgtactctctcaaagacggatccaacaccatcactggcatgccagaaagcctcctatttatacctcgacgctcgtttaaggaagactcctcaggtggtgtcagaaatctgttggcaatctttgaaggtgggatcgacaagcgagcttgctgtgggttcaagtctgttttgaaaagttccttctgcgtcacaaactgcacgtcacatccattcaactcttggatcttttcttgaaattcccttggcaatccatcaagttcatcaggtggcccttgctcataacccacatttctttcgtttctagcatcttccctttcttggaagcgatcttgttcttcttcatatgcagtaaataaggccgccactacatctagtaaatattcaaactttgatttgccatgttgtgaagaactagccccttcgcattcgcttttggctctctttgatgggttataattattttctaattctttttcgacttttctttcgagactgatctttgcacccatttcaggatgccgcaggtgcttttcttttgctgcaacaaagtcacgaaccaccgtcttcattggaatagaagctgatgaatcttctccatgcccgaattctttctttccacctgcagtacccattcccaagttgcacttttgcagattataagatttctttctttttctaatgatctcctattatcctccttcacctctctaatatatacacggatgtaaaaagataatcagcaccgtttgccactctaatgtagatataactactctgtaaccgaaagattgtgtaaaaaaacttaataaagataaatcataagataatatataattatgatagtaaaatctgatctaatataatattgtgtagataaggtcacaagataactaaattttattataatgtaatattgtcaagtaaaattatatttatattctttcttttttttataatcttctatctattttttttaattgcattgaaattgaaatatatacaagattgtaattcgaatttagaaaatataatttaaatttcaaaattatatgttttggtgatgtaaagttatagagtattttattttaaataataactttatttaaaacaaataaaacacgttaattttaatcaatcataagattttgttgttattggatttataattttaattttaagaatacaattttaattaagattgataaatattactgtaatattaatattcagagtatttaaaaagatagacatattcagtttgataaaatttatcaaaagtttaaaattaaaattataataacgattaataattttaaaaataaaaattataaataaaaatttaaaattaacaaaaaatttctcaatgtgaaattacatattgttcaaggcataacttgtttaagaaataattgatttatttaaattatgtgttcgtttttataatttaaattatgtatttttttataatattgtttttgtacgtgattagactttttcttagaaaaaaaatattattactaatatattttataaaatatttttggtatatttcaaacttcccgccacaagaatacagatataactgttgtgtaacataaagattgtgtatagaaaacgtaataaagatgaatgataagataattatgatagtaaaatctgatctaatataatattgtgtagataccctcctatagatattgataagataactaaattttactcaaatttaatattgtatattctttcttttattaaatgatgcgaaattatcaagtaaaattatatttatattctttctttttttataatcttctacctaattttttttaattgcattgaaattgaaatatatacaagattgtaatttgaatttagaaaatataatttaaatttcaaaataatttgttttggtgatgtaaagttatagagtattttattttaaataataacttcatttaaaacaaataaaacacgttaattttaatcgatcataagattttgttgttattggatttataattttaattttaagaatacaattttaattaagattgataaatattactgtaatattaatattcagagtatttaaaaagatagacatattcagtttgatacaatttatcaaaagtttaaaattaaaatcacactataattataaataaaattttaaaattaagaaaaaatttctcaaatttgaaattacatattgttcaaggcataacgtgtttaagaaataatttatttatttaaattatgccttcgcttttataatttaaattatgtatttttttataatattgtttgtatacgtgaatagactttttcttataaaaaattattattgctaatatactttataaaatatttctattgatatgattcattagattaagttgataagtaaatatttttattgtttgtaggactttattttcaattgtgagggatagtctgtagccttcacttttgtgacaaactgggactgcaacaatgctgcttcaatcttcaacagttctaccaagtgaagagttattgctttaagagactggttgaccatccaaatgttatcaatatcagttactggagttatggaccagaccaactccatatcgaaacccatgatatatgttcctgtttgccaaccggattcaatcaacaattctaaatgctaatatagattaaggattatatttgtcaaacaatacctttaaataggctagttgatcatgttggtatatggtatctattattaacctctttttatttgatacacagtagaattgattgagttttaaattgattttagataaatttcagatattttttcatattaaataggagtttagaattgactgtgaatccaaaattgatggagttgaaacaacttttgatatcttttgcatgggatcaacaaattttatataaagttttattcctaatttataataaaaactttcaaacataaatcatagttttagaattatttttaaccaaaaatcaattttgtcaaaacaatttcactcaaaattaattttgtcaacgctcatctaaacatgcactaagatgtgggtacttggacattccaaaatttgttgtttggttgagaagaggggaagcataatagaaagagaaaaattgtgactcacatgcgaatctcgtacattctactttaattcaaatatctattttttttttccatcttctctgttttcatcctttcaaccaaagacagcataaaatctagactcatttgggtatgacttggtttagcaaaaataattattcattggattaaggaaccttggcttttttgtgttgaaacttctaatggactaaacttccgacattttcttgaaagtgggactcactggtttggtgatccaaaccagcacgtgctaccccatttaacgttacaaatttatgcttctctatcactttaatgactgatagttatattttcagcaagctacccaaatttgtgttggatgttttgagtgtattttggaagtttcaaaggaatcaagtctcacattggcacatttgatcagtttttcacatgcagggttattagagcactgctttcttgtttctatttctgcattttgtatttctggtgtcttctaggatgatatattcacatatagattgtctgaactctgagctgtttctgttagaattggcacacaacttgtcacttgtactattcacaaaggaactgctgttaatagtggtcactacattccccatatcaaggatgaaaaaacactgggcaatggtgggaatttgatgacaagcatgttactaacttgggtttgtcaatccaaactactttaaaattagattagatttaaacttaaactcaacacattaaatgttaaagtaaataactactgataagattagatcagaatttttctcttcaaaactaatttcaattcatctaatctgcaatcacccttacataacccggcatgactccacgtggttgtcatcagacatggcactaaccacaaaccgtaggccaaccaatatcgcttcaagaagaaaacgaagggctagaaatcataaccagcaacaaaaatatttcgccttttggcacccaataaatatttcatcagtgaaagtgcaattcttaagaaaggacaccggatgacgggatgaggatttcaatttaacaaactgtagaatctaacttggaaaaccaccttccctaggcaagtccatttattattagtgtgcctaataaattacatgtggactcaataataaacttcaaagtgaaaaggaaaccaaaaagagaaataagagttgaccacaagtcacgcggagcatgtaactcaaaacaaatctaaactacaagctttacatgtctaagatgaatattaactcttggaagcctttatctgaagcaagcacccatcttggctgcaggacacacaatctagagacatcagaatagcttgccttgttgttgggttccactcctcatcatggtacaaaattcttcatagttgattctaccatcctgagaaaccacaaaattgagtgtcaactatggatagaactagagtacaaaattgtagtaagcaaaaagaaaaacaggcttacattatctgcgtcaacttcggatataatttccctgattgtggcctcgtcacccataccatactccttcatggctgtttccagttcatctcttgtgatatacctgtgatggaatcaaacaaaaatcagggtgcatgtgtcattactctttaaattctaaatagagctattcattatttaatgattctgtaatgtatgtgcttttgggtgtaggaagaaataggatttatggtatatgatcttgttaaatacttattaaaaaaactgaaaacataatccgatagtcaaaagattaatatggaaggcatggacttcaaaattgaggttgagaatgcatagtaggaaaaaagaattacttccataatgtgacagattgaggaagaaatgttaattcacagtagatggatttacccgctgtcgtctttgtcaaaatattggaaggccttgtaaagatgctcatctctttctaacctgtgtctatgcattgtagcagtgatgaattctatgtagtcaattgtgccatttccatctacatcagcctaaatttaagcaaaggagtgtaagcttgaaagaatatagaaaaagcaaaggagggcaaatcttgtgaattcaacaatagcttacggcatccataagctgtcgcacttcagcttcagtaagctttgagcctagtctttgcaatcctgccctcagttcctcataggtgattgtaccactattgtcagtatcaatatttgtgaacattgcctttaaaccttggatctcttcttcagaaagattttcagcaatgacctaaaacgattatttaagtccactcagtttatttttgaattggtagagatatgtacccctacaccctatagttacacacagtcgagcaatttaaagtcattatgagaacactggaaaaaaaattatgtctctcaatgtttaattatgccatcaaatacaataagcataaaagagcattgtggtcacttcatgcagcttgtggcttgactaaccttgagggctagtttttttagtttattcattgctctgaattgcttcattctggaaagcactgcactgtctattggcttgtcagaagcatttccaccttctttaagccatgggtgctctaaatatttaaacaatacaaggaatcaattagtaaagaaaatataattcatgaaccaaaaaattcttaaggatgctgcaatcaagctatcagtcagcagtaatattaacgggaaacagttttgagtcactgcatcaagacaaagacacacactgttactagcttccctcgtgttcaataatgtttcattttctatcacatacagaatgtcctataactaaacaactgacatgtttaaaggatagataatagaagaaacagtatatttgtgaaaatattgtctctgaaaagtccctagtctcagcaactaacatgttcaaatgcatcattggttgtcgttgtcacacctatatgggtatagaataatctatacagatggaaagatcttggcacgtataagtttttaagccctaaattcagtttttatatgcaacattactattagtaataactatatccactagccttgttatgtgttagatagaagtgaagggaaaattagttgggaactagagtaattagttggaggggatcaattagataaatatggtgaagggtgaaactgtgaaaggattcattcagagaattaacaagcttgtaagaaagggggaatccttagaggagaatccatgtttcggttcgttttcattcaataaataaaatcaatctttgggttgctaacagaactggaatatatctaagcccctttagtgatctatcttctcaacctcacccaagtacacacataaaaggatcaagtaggaaagaaattcaaactatcaatgaggagaaaacacaataaaagtctcctacctagaacctgagcagcagtaatgcgtttctttggatcctttataagcattttgcgaacaaggtctttagcactgtttgatatgcttggccatggattactttcaaaatcaatatgaccttgcaatatggcatcaaatattcccttttccgtctctacatcacatattttattaaaaaatagtcaactgtaaaacagggggaggctagcctctaatacaaggaaattatcctattatcaacatatcaaactcagagtttacctgcccaaaatggtggtacgccgctaagtaagatatacaatataactccggcactccatatatctgcttccttcccatagctacgacgtagaacttctggagcaacatagtaagcactgccaactatatctcgatacacctttcctgtgaagaataaagaattaatagaaaaaacttagtatgttttatacaagtgagatgatgtataaaataagtaagcgaggtttatcaaccgtcaatttcgtaaacttaatttactttaaattaacagtagataaaccctttctaacaagccatcactttacaatttccatctccatacttgcaaaaaaattaattcataaatcatggcacaaattgagtggcaaagatgtccatctactgaaatgtgataaagtgcatgcatagatatggagaaaaaagaaaaaggagataaagctttagaaaaattagttggcagaagtttattcaaataaacatcttgagggagaaaaaaaatatcccatgaaacaaattaaaagctactcaaactttgcaagtcttgacaatcaggccattgatgtcaagcattggcaatgcactattagaacttaatagaaaaatcattttcaatcttacatgccttttgcatccaattcccccccccccctccccttacacaaacacacacaaaaaaaacaaaaaaaaaaaatggatggaaattatacaaaattttcctcaaaaactttagaagattattcacaactatgctacagttcacatacttacctttcaggaatccccacaactattaaaaattcataagaaaagaccaatgaatggataacaaaatataccttcttcaatgaagactgacaagccaaaatctgtggccttgagatgtcccttgtcatccttactggatagcaagaaattctctggcttgagatccctatgaatgacacccataaaatggcaggtgttaacaaccttaacaatctgtctacatattgaagcagcagccctttcactgtagtggcccttggcaataatcctgtcaaaaagttcacctccagcacacagctccataaccacatgaactgattgtttatcctcaaaagcacctttgaactccacaatgttggactgtccactcaaatgctgcatgatttgaatctccctcttcatgtcctccttgtcagctctgctcacaagcttcctccttgaaatggacttgcaggcatactgcaggccagttgaattctcagtgcagagataagtaaccccaaattggcctctccccaattccttcccaagtgtgaagtgctgctttacatcctcaaatggcttcccagtgattgtgtcatgcttgtgaacatgttttgggcttggtggaggcctccagggtgcctgaggaggagcatgtttctcatgtaattggtatggttggtgagaagggggtttggtttgggtggcaaagggttcatggctcttgtgattgttgtacacaccagcacccccagcaccggcaacatgtctgtaaccaatgtgttcttctggctctgacccttttttactcagacaacaacccatggttctgacaccaaaagggaagagattttttaagttttatcaggtaccaccacacaaccaactacttgaaagtgtgaagattcagtcaaagaatgaaaaagggaatgaacccagaagagaattcaagaaagaatatccattgaagtgtgaagagagagaaaagggggggaggggggaggagaagacaaaggttgatgcagaatggatcagaatatgtggttttttaaaggaggagaggaaagtagaaagaaagagtctcaacaaaaaggataaagatagaaccgagtcaactgtgggattcggattttaacgagttaactaaaaaagggttgaaactattttacgaccaaaacaaggttagagccttggagggagtccatataatagaagaaaaacttccttgattcattctttcttatgattcaaggaccgaatcagagatgcgtatccaacaccacatttttctcctgattcgttcaccacatgctgccacctaatttttgttaatgagtaaccaaaaaaaaattatttagtctaaggtttttgtttttgtattttttatgttcttcaaggactaaggtgatgctgctctcatgttcgtatttggatagacttttgcatttccaataagcgtaatgaaaaaatttatctgagatagtataagcttcgcacttaagatcattgtgtcaagagaaaagaaccattgataaaagaatgttgaaaaatatatttgtaaattaaccaaatcattaaatagctgtggaggtcagaataaataaaaaaacgctatggagatactatgtgtgtatcttagtatgtgcacaattctatggattcaaaatcaaattttataattttcataaatagcattatagattccttatagatcataaaaatatataatcataaataatattgctcatatctctttattttggcaattacattattggaaatcattaattattaatttaatacaatattatattttcatgtgcgtctattatataaaggttgacttaaatgatccttaatttaacaaaaaaggaaatgtgtgcaatacacttaattcttttgaagttgaaaatcttctaaaattaaattaacatacatctttaagtagaaatcaacaattcctcaaattgaatcctgcgtaagaactcaggatcagcatgccactctggggtcttcaatgaaaaaattatgcttccttcgataaagtgtgagacattattctaataatttagacgttacatttatttgtaagtgttttattttattttccaataaaaataattctcatgaagtcatactaaaaaattgttttggttgtagagcattttctcaatattaaaaaaatgacaagtgtgccgagaaattattattattgttataaaatgtgtttttggttcctgaaattttagtcaaaattaaccttaaatcattttaaaattgtgattttcatctttaaatatttgatcaaaattagatttagtttttttttttttttaaaaaaaggtttttaatgtcacatggcaaacatatgatatccatatgatcgttattagtcatgccaacaaaatattaataaagttaggatgagagactgaattcacctattttaaaaaaattcaagaaataaaaccaaattcaatgaatttttggagagcctaaattatatatttaactcttttattttcatttaaattgtcaatcaattaaaacaacataattaacaagtaataagaaaacaaaacaaaaaccataaaggatagaaacacttctcctaactttaggtttaaatagagtttatctcgttagttttcatacgtttaggttcatcttccatgtttgtctcccatgtttgtacggaccttttgtcatcttttaatacattttaaggctagctggtttagttagattattaaggtgtcaacataattgaaatgtcaatatctagttatagttagtctctattttacctcaaaaaataaaacaaaaactagcattttagatgaaatattatacaagctaaatttgtattagataaatatttattcttataaaattataatttataataaaaaaatatttataatttattaagtgtattataactaaattataataaataaatactttttaatatataattacattttaaaattatattgaataatttaaattatctttgaaaaacatattaaaatccacacaactcccccttctaattagagcatatttaatgtacatattttgatgggtatcttatattctaagatacagtatcaataagaggtaattttttctgtttgaaataagaagaaaacaaagaaaaaaaacaagtgtgaatcttgcttcaatttttttccctcccataagaggaagtgtgatggaagaatagggaaaaaaattcaaaaaataatccttgcaatgcattttatttttataatatttatgaagaaaaaatatatttattttttaaaaaaatcaaataaaattaatgaattccttttcttttcttttttattcatttttttctcttgttttttctccttcgccgaatatgctaatcacaaataaaagaaatctactcgtaactaaaagagaaaaataatgtgcttgatgacggtgatatgatggaaattaattggaaaaatatgatcatcaaatgaaataggacacatgtgaaatgtaaatcatgaaacgtggacacgagacaatatataattattatcatttgcgtagtagttaactctgaagcaagaaaacgtgtacacgagcaagcaactcattcacggtttttatttcattcaaatcatacactttctggtcaaattctcagacccccaacagattctatgtttcaattaaaataattctcgcacttttgctttattagaaacactgagtaaagaaattaacgtgagagaacacaatctaagcgtttcctaactttccttgcactttatttaatagaagtgaaataggtaaaaaaaaaaaaaaatgtcaagagagatgaaattagatggaaaattaaaaaaagttgaattatttgattaagtttaattaataaggagagaaattaaaaaattgtaggcgcgccacactaaaaaatattttcatgctaaaatgataagaaatggaaggaaaatatacacaatacgcgttgctttaaggaacacttcaaataaaatcctactttataatttttaaactataaaatgtttttttcatccacagtaatagaaggtgatattaaaagatttatcataactcataaatcttactcaaataattgaactagactttcttaataaatgattttatcaagttttagtttttatgtactaaattaattaaatcatagctctgaataacaatttattgggactttaaatctaactactacattgaccgtgttaacttgatatttcttaattttgaagtaattattactttaacaggaaaaaaaaaaattatttgtcagtatacaacattatgaaaatgtttagttttcaagtttttctttgtaaataatacttagggtatttttttatggaattatcttgtatttttagaaattacgttcccataaatttgtagtgaggaatgttattcctaagcatatataaaaatatgtttggttaacttttaacatttctaataatatttaaggcaatttttgtttttcttctaaacgaatatgatatcgagattttttattggagcgtgattggtttttttcagattaataaatgataaataaaagtcaatttggagctttctcatcccattagaatgggaagaaaagttgtagacataggaatgtaactttcttgagaaaaaaaagaagctacctttgtagtttattctttagcttgtaattcaatagagaatctcaaacactattattttattttgtgcccagttttacagtttttgggaataaaagatattcatgaatattttctgataatttcttattaaatatgggaataaacattctcacctttatatttatgaaaatgtaagataattttgtaaaacaaatgttattctctattaattctttatctcctttttgtaggattaatttttgtattgataattgtaaattaagttatttgttagatgaataattattgaggtaaaagagaaatacacacaaagaactataattgtccgatgctaaagatgatgatacacaaaccatggacctaatcacataaagccttaaaaaatggagcacgtttttttggatactaaagatgaatttactttcacatatctttttgggtaaagcaaatgggtatgccctttcttccccctcccggcctcctcatttttgggttaattatttacaaagtggttttgcttttcttaattcttctgtgacaataataaagctatgtttaagtttttgaagctacaaaagaacttagctttcaagtcacaattaactttcctagcccgcttggctagttgagttgctaaagcaacctttattttgtggagatgccgattttattttgttgtgttataattttggttggatgaatacttgagtgtcgttatgtacatgtttagggtttctttaattaaggggaaaaaacaaaatcttaattagtattattttttaaatcgtcaaaattataaataaaaaaaatcttaacaaaaacatacttatgttaattactatgtttataaaaggcaagcaaaagaccaaggctgcaatgtctttgtagagctatggcccatgaatctaccctatgtaatgggagcaaatttgtggctgaagtgagtctgttaaaagtgatacaaattaagggacagtgatatttcctcccttgtcttatacaaatctttttgctaactaacatgccataagttgactatttagcatttcacatgctattctattttgataacttccaagaaaattgccattattgattgaaggttagtgtttattttttaacaattattaattgttattttgttaatttttattattattgagagaaatttgaatccataattattttttctctctatcattattttgtactgccagaagtaattattttattaaaaataacaatataaattaaccaaatcatgagaaaaattatcataatatatttattgggtgtatacatctagtgaaagataaatgtataaaataaaaatctagtgaaagataaaaaaaaaaatacgtaaagagaagtaaaaattataaggagtgatgtaatgttatataagaaaaagagaggtacggtagagaaataaagaaaaaataaattaaaaaaagtgtaaaattagcaatattgttaaaaatcaaaatcataatcaacaatgagaaatcacacttttgttttttggaatctttcatttcactttaaaatatcttttcagctaagtgctaatagctaatggctaataacctaatacaaacgtgtaacacatttacccaaaaaacatgtggcacttcacctgatcttgagaaattgttaggagtttgtaaaagtggttattattttattagtttgtaatatttgttgaaatgttattttatgaacgtttaagctcataggtttctaattctttgaagaaaaaaaaaagttattttcatttttatctttattatattatgataactcttctaatattgacaaaatgttgatactttctcttattctcattaaatatcatttctttaaaagataaaattattaaaattataatataacattatttatattagttcattacattaaatacaaaaaaataaaataaaaaaataagaataaaattaacgtactagttatgatgtggtgcgaatatatatatcatggggctacgtgtgcaagagaagataaattaaacggcatagtaagattaattgaagaaattaaaaagaataaaacaacaattttattcctacattattattgtttctgctaaatagttcctaaagtaaagaaattatataactaatccctcaggtattaaaaattgtattacataattcccaattataaaaaatatttcaaattaattcttggacgttagtaaaacatgttaatatatggaataaatttatgctaattcaatattctaaggattatttatataatttcattagttcaaggactatttagaagagagaatgatacttgaaagactgaattataggtttactgaaataaaagaagaagaaaaacacaacgaaacataaccaataacaaaaatgcttcttctactaaacaggcaggtatataagtatattgaactttttgattgggccaatagaacttaaaatttcagttgtgaacccaaaaaaggcccaaaaccatcttttaaacaacctaaacacattttatgtaaggtatgaaaaagactgataacaaatttcagttgggacagtaattttgatgatcaaaacgcaatagtagtaacacatttaatttctgataatatcgtggaagtgaggaatgaagttgccacttctcaactccccagaaatacgaaaatcttgtcctggaatagtgtgataaattgaacttctatactccacagccacacatatatattatatcaggggcagagtacaaactacctaaaaaactagttacaagttaaaaataataattagtaatcgaaaattaaaaaattagtttattaaattatacgtatttttcataaaattaattgttgaaataaatgaaaaatataaaataacaaaaaaaataataaaattataatttatttaaaaatgataattagaaattttgataaatatattacatataataatagaaaaatataaaaaaaactaaaaattaaaaattagtattttaaaaaatattattttcaagtaatgtttaaaaaacactaaaaattattaaaaagatattaaaaatgatttatttatttattaaaccctcaaacaagtttttcaacttataaaaataagttaaaaactaaataaagtatgttctgaaatataacctgaatcttaggcatacttgctttgacatggaggagggacctgtctcaagattggaaagtggttttgggggcacacccaattcacgttttacagaactctatcggtgtctcatgtatgtttgtttcataaatatgtaaacatttacttcacataataattgtactttaagatatttaaaaaaaaaatgtactttagggtttcggaaatatattaaaactcaaatcatgtacaaacttctcacaagttagtgcagattttttgaattagatggtggttggaacaataatttgtggctggatttttctttctaaacgaagttgcttttcaaacaatatacaattaaactgtttttttaacacagaaatagaccaacagtgacatcaataataaataagtaaataaaatatgtaagaaataaataactagttttaaaactaaattaatgagggaaaaaataaagctaaactcttaagttttcatctccctcgtagtcgtaggtctttctattccttactctcattttcaatttataacaattgtcaatattcctattccaaatcaatgattggctaattaagattaaagtcagtaaccctctccttctttctgttttggcagttgatacgtgaaaatgaataaacgcatagcttcaccatccataggtggaagatctctgtgctaacatatgttttcattgctcttacttttttgaatgaaggcctcatttgattgattgattaaatccatacaacatgtgattaattaataggacataaatattgataaaaagagaaaggctcgtttttttatcaaatcaaaattcattttaattcagtgcaagactcattaattatatatttatttttgaaaaaattaatcatttaatccaaactttaccttttattttctatatataaaaccaatatttttagtctttatacaagtattttcatattgtagttgtcgttataaatagcaatgactaaaaaataaagtttgtataatggcagggactaagagagatttgaaagtatttgtgcaaagataaaacgatatgatttttaagtatagagattaaaggataaaatttatgtaactacaaacaataaataagtaatttttcattattttttatgagttcctttctttaatatgtttaacaagtattttaacttaatttttaatttttttattagttaaaaaatgtttgcttgatcgcattaatagtctttggtaaacaaacttattttaataaaatataacattttgatttttaccttcttatattttatcatttttattccaaaatatttattaaatttactttattatctttttctacatatcataagatagggttttattattatttttccttccattcatctccacatccaatattgtgattgacgtcatctttaaaaattaattaaaaactataattataatttcctaaaaatactttttattcaaagtaaacttaaaatatgtaaaaaaaaagtctactaaaatagaatttttgccccttatctttatatagataactttcaaattcagatgtggagtgttttctctgcattaatatatataaagatattatgtatcatttaatttaatccgatagattagatatgttcagttctttaaatcaaaattcgagacttaaattaaattgatcaaatttttattttttttcaatttgaaccaaaataatgatttaaatcaatttgagtttttttatactaaaattagttaaaatttattgaattggggagttgatgaccatcctaccatgtagtacatatggagtttgtatagtgaaaagacaaaagataaatagtgtgttttctaggctttaaatcagatatggaatgtttttttttactaaaatgaattaaaatttctgtgatgtattcaattgtaaatagtaatctattaaagttattgccaaattagagcgtgttaactatgctttttttttataaagaaattaattactcaacttatcattttaaactttttaaaataatttatataataaaaaagacagttattgaggtcagcccaatcccttacctaaaaactttataagacgaaaaaaaaaaaaagaggtcgacccaatggtaaaggctattaataaaatttacctctgccaattactctatttacctctctttttctttttcttttttattttgttattcaaaatacccttttgtatcccatttttccagtgagggtcaacaacgtgaacaatttccagaaccgtccacctgaacaagttcggaatggcaatgcatgatgatgaggaccatgccatagaataacaaaataatacaattaactctaatcctatttaatatttaatacacattagataacaaataaaataaattattgttatacaaaattattattttatttatatagctacttttcttaaaattataaaaaaaataagatttttaaaattataattatatataaaatatataaattataatatacatattgagggagagagactttatcctatcttcttattactggaagaagcttatatcatttgattctaaataagagtctcaatacaagttgcactaaaataaaataaaaatatatattaactggcatgaaatcttaacaacatacactttagcaaaataatgagtaacataattcgtttctcttctaatgtaattaacagaatagttgttaatatagaataaactgtctctacacttgagaagaatggaaccaaattcagtttgtacatattaatttttttattgtgcacacacacacacatatatatatatatatatattaataaaaaaaagtaggacgaagaggagagaggtgttaaacttttccaattaaaaaatatacttttaaatgagaataaataataaaacgaaacttaaaataaaaaaaaaaaatagaaaactgaaatagtagaatatttactttaaatgaaaattttaccttcctttatttttatctgaaattatcatattaggatcttattatttactttttattcttatacttcgataaaaaaattcaaattattttttaactaataaatgtgaaaaaaattataaaaatctaaaaacaaaaattttaaggtatcttttcatgaataaattaggaagaagagaaaatagatgttaaatttatatttacaaataaaaaataatttattttgttaaagaaaataataaataaagggaaagctatataatattttattttgaaataaatcataataaaatatttatttaaaatttaattattttatcttcctttatattttatttataattatcactaggattttattatttactttttattcttatgctttcatataaaccttttaatttttttaactaattaatgtgaatgaataaaaaaaattataacaatctaaaaaaaaattacctatcttttcatgaagaatctaggaggaaaaggaaagacaaattaaaattttatttaacaacaaaaaaattattttttaagagagaataaggaataagaggaaagttatctaatattataaaaatatatattaattaatataatatttactttgaattaaaatttcacctttcctttttatctaaatttaaaactaggatcgtagaaattacttgatttcgttccaatgcttttacatatagcaaacttcttaaaaaagtttaactattaataacattaaacgaatggttttctaacaatctaaaaacaaagcgttgttgcatctatttatgaaaaaattaggaggaaaaggaaagagctgttaaatttttatttatagataaaaaataaattattttccacaaacaagcaagaaaaatggaaaagtgatatgataatttttataaaaaaaatctcaagcaatagaatattttctgtaaataaaaattatgccttccttcctttcttatccaaaattattactaggatcttataatctgcattttgttcctattcattcatagcaaacttttaaataatttattaactagttaatgtgaataaataaaatatcgttaacaatctaaaaacaagtatttgaggtatcttttggtgaagacatcaagaggaaaatgaaagagatgttaaatttttatttataaataaagcaatttattttctaaaagagaataagaaataatgggaaagatatattttttcttgaaaataaaaactctaataagagaatatccttaaatgaaaatttcaactttctttttttatccaaaattatcactagggtcctattatttactttatatttctatgcttttatagcaatttttaaattgttttttatttgttcaacgtcaataaattaaatactttattgaacaatatatcagattctttgaaaatattagagaatatctatttgacgaagttataagattaagttgaatgacttctcaattaatatgttatatgaaccctcccgaaacaaaaaccatttatcttatgattttattgtataaattgatcatatctatcactcatgattgtaaccaacgtccaacttatcatatgataattactcattgatttttacattctaaaatcactttgaccataatattataggagttgtccgctctatataataatccattgattactacgttctaaacccactttgcccacagcattgtaagagttgtttgctttatataataatgtttattctttgaggtttcaaaattgatagagcaattttgagatgattggatctcctttttgaggatgacactcctttctccctcttgcctttaccctttctctgccacatgaagatggtacccaaagccattggttggatctcacctaaccctaatgcatctttgcctcacctcaactcatccttgttacaaccttgctcttgtgcagagcaaagttggattttgatgcatcttcaccataaccttggttttacatggagagatattttagatttagtgtctatagtgttactcgattaaacctttttacactttatccttcaatttggtgtttgttgttaccatggttgttgaaatcaagatcttacctaggattgagtggggaaaaatgtgatttggatcataagatcctacatttctttcctaaaatacttataaataatatataacttttatttttatttttctttaatttcttatatcatatattatgttttttagtttatcatattattatattctttgttatgttttattttttgttaattacacttataatactattatatttcttcttattcttcttctttatttattatattatatgtaatattttacatttttaaaaaactaaattggactttaattaaggcccaacaaatcaaatatgaaaaataaaataaagaaaaaatttggcccaattcccttgaaaccctaagtcctacatgtttctcctataaatgataagtgtcatcagccactgctgtaaaagtccaagaacaagtgcaaccctaattccttatggtagacagagagcgtagatagaagagtactaggaggttagcgactgtaagaacagaggttgtttggcaacaacacaacaacgacgacacgaaagagtccccacaaagctcgcaaaatacctttatttgctcacctaaattgtttagataggattgcatatcccacatgaaagagtgcaaatttaatctgatctcgcactccaacgatcctaacgacgatgcaacatagagatgtcttcaaaaatcgttgaatcgcacgttccgacaatcttgattgtgattctaacagcattggctactgcatcagatagagcagtgattgtgggtgacaattgttgcttcagtgccaatttggatctggatctcacttcttgactttaacacttcatcgagcaattctatattgaggtaacactattttgataactcaactatatactttaaatttcccatcttttattccatgtattgtatttttcatttaggtaatctattgcttttgagcgattgttttatttatatttttttggtgttttgacttcagcggatacttttttgtgttgatttgattgggatttttggagcattgtttgtttttgcattgatcttatgcatgttgtgacataaaatggaatgctagttatgggcagtagttggtgcctcgatggaggtgtggatctcagtatgcctctccttcacacttgctagggtttccttccatcacatcttgattttgcaactttgtcacacaattctcaatggaggtaacatcatttcgataacttaattgtgtacaaaatttccattttttgttccacgccttgtctttttcattttggaattctattgcgtctcgataattgtttgacttttgttgtgtttttggcttcaacgaatccttttgtgttgattcaattagtatttttttggagcattgtttgtttttctattgattgagtgattgttgcaacacaagatggaacaattatttcgaacgatggttgataccttagtggtagagtggatctggactgcctctccctcactccatcttccatgcacccactaggtttcccttccatcacacatagatttggcaatttcatcgtgcaattctctgtggaggtaacactatcttgatactcaattgtgtactatgaatttcctttttttccatatcttgtctttttcatttaggtaatatattatttttgactgattgattgatttttgttgtgttttggttttaataggtttttttttctgttgattcaatttgagactttttttgaagagttgttgtttgttttgagctttggtttagatttctggtgtgagagaattttgttttggaaattggcacgtattacatcgattctatttagaaatgatgtacaaaaattacatccattctaacataattaatttgaaaaattctaacattttacattggctgattcgtactagcgatatagaaaaccccaaataatcgacataataagggagatgtagtagtgtaactgtgtgtgtaatctaagagcttatttagtgaaaagatttttataaggataaaataataaatattgatatttaaattacatatgtaaataaagctaaagaagcatgtcttttaaatctaatgctagatatacattgtatgataatgccatatatagtgttaagttatgtcttagtttatatatatggtttggattaataaaataattgtgtatgaaaatgaataagagcatacaaagaggaggatgagtggcaaaatcattgctttggaccaaaaaggaaggagaaggaaagccatattgaatcagccaaccatggcataaaaaacaaaggaaaaagatatgaaaccattgatttagctgaattggtcttcggattagaatatgactctgaataagataatgacaagtatgatgagtcatgttatcaaaccaagactaagaacaaacccaactacagaacactcaagaagctaatgccattaacttggataggtttcataagttgatgatttcgttttcttaattgttttgtaattgggtctctttctggtcttgatttggtaaatatggctcatcatccttatcatcatcagattcagagtcaaattttaatatgaagaccaatttagctaaatcaaaggtttcatctcttttttctttatttttcatgtcatggttgactgattcaatatatctttccttctccttccttttttggtccacaacaatgattatgctactcatccttttctttgtatgctctgattcagtttcacacacaattgttttattaatccaaaccatatatataaattattgcatgactcaacattatgtataacattgttttattttttgttattaaatttattaaatatcttcacccttacttctcattcctttttttttttaaacctttctcaattatgtactataaaatagaaaggcttgaaggagaaaggattgagagataagagatctggatatttaagtaaatttaataaaaaaaaaaaaatgtatatctaatatttatgggagatatgtttaacaattgcctatagtctttttgaaaactaaaaaaaggtgcgaacttagagaaaagatgtatgtaaataacatgggcccaatcaaaactgttattagggtgaaggatgggcccagcccatgaacccttggagcccatccattttaagggaccaaaatggtaaatgagtgcctgagataagggtagttttggtaaaaagaagtgactgttgcagcaaagaccccccaaaaacaaactccaaggttgaagactttgacagagtgagagtgtaaggtagagtcagtcagagatatagaaatggcgtcgtggtgcggtgctcgtagcttccagattccggcgatggaaggcagcgcactgtgcaaccgtgcttcattggccgccggggtagggtgtttgtcggtggtcggcacctccttctggcgctcctcttcgtcaccgaagcactctttgccattcacatgcttgagcatttcttccgaaactcgtaagtacccattatgaagaaaccttcaaatttttaaacttttacttttttgttataatggtgacccttattgtttgtaggtattaagaaaagtgttcaaaccgaaggggcacctgcggctctgggaccatattctcaagcaatcaaatccaacaaccttctttttgtgtctggtgttcttggccttgttcccgaggttttttaattcacttaattgtcatcacttcctttaatttatgatgttcgtttcttcagattgttgatgtgtgttttgctcttcaatgcagaccgggaagttcgtatctgatgatgttgaagaccaaactgaacaggtacagaatgagacaacattttatcttgtgatattacattctttgaatgtcaattgttgtattgtatgatggtaacattttattgatgttgcaatgcacttgttgattttgttgctgacatttgatataattaccctttgtagcttcttaaaaacatgggggaaattcttaaagccggtggtgctagttactcgtcggtcgttaagacgacaattatgtatgaattcctcactcatttgtggttggggtttattgcgtttcagcaagattactagtttttgagtttttatttcctgcaggttggctgacttgaaggacttcaagaaagttaatgagatctatgctaaatgtgagttctgtggtattgattttaatttttaatgtttccttgacagttacattcttgtagaaggcgaagcttgcactaacttgtttaggtgtgaatccatttcatattgcagatcatgaaagtcctgtattgacaaactgcttaactgtgctaattactaatgaatttcacttctgataataatttgtactgtgctgtaaaaattgatcctgctgcatttgtgggctgagaatgtgttagcctgtaggtaacatacatgtaccatggctgaccactgaccagcttttagattcaaaaccttcatgcttttttatgatttagtcttgaagattcacctgttagcttgtcataataggtaataggttatgttgtcaacttgtcatatttaatatatactaagggtgattactagattgatactagagagtccactagtaccatgctgaaaatattaaggttttccctttgggttggtattatttaattttcactaatgcctacagttacttaaataattttaatttaactgcttttccaatgatttcagacttcccttcacctttccctgctcgttcaacttatcaagtagccgcattgccattggatgccaagattgaaattgagtgcatagcaactctataagcatcaattgtaatagtacatctggctccatcagcaaactcaggttaataatgcaggaagggacatatcttagtattgaagttttacttagttttgttctttggataatggtgctcttgtgattacatttaccatccaagcgaggtctctaatcttcggattctctctcaaagattatgcacctatttaaagtgaaagaaacttaatcattggatgtttcttgtttgcagcttttgtgacatcgaatcacataagacagaccatgaataagatcatttttaataaatatattttactcgaactcacatctattttctttagattgatttgtggacgttacattgaaaaccttatagtacgtactgattatcttctttttcttcatattttgttctttaactaaagatatcatttggctgatggttagatatgaattccttttgaggtactatataagtcactgaaatggattgaccaattcataaatataagtaacagaaaaagtaaccgatatacaattagtaaagattgtttattaattaaacgacagagataaacccgtttcacttctctccctaaaatgagaaggtttactgtagacgatcctgatccttgattagtatccgttagtaacttgtttttccaattcaatcttttgtaattttgtttatattatcatttgattagttatgcttaaatttctctaccgattttataaattagtttgcattttattaatttaggttttttttcccaaggtataatattacatttccaaaaatcttatccccaagaatactatgtttacggatggaattttaataaacatgtttggtttggttgacatttaataattttagaaaaatatttaattaaaattttgaagaagaaaaagtagaggaaaaaatgtggaagaaattcaagaaagaagtaggaatatggagttattttagaaaagaacttttattttcattaaaatgttttatattcctaagaatcaaccatacgtggatatatatatatatatatatatatatatatatatatatataatgaagtaaacttgagattgtgacattcccaaattcacttttctgaaaataatttgtgaaatcttaaatcaaatccaaccttaatatttaagctgttatgtttttttctataatattttccttaatttcttgtgttaacaattctcgcttccctaaccaagtttatgaatacaacccttagatattgaaaatgtgtaacttgttttcattgagaaagagggaaagaattcaatctgagttgaacgatttagagcatatttgactaaatgttagtgaagaagaacgtaaatttgtcaacttatcatgattctttcttttatattggaatgttggatttgtctcaaaattggtaagacaataatttgaacggaaaattaaacatgcactcaattattcaaactatcgacaaacatttgctactttgcatccttaaaagctctggctcagattgtgtttttgctacacaggccttggattcttataaggaggattaaggcttccggttgtgcattatatatgaatatctgagaatcgtataaagcaatttgccttgcatttgcatccaatgttgttcttttgccagttttcaagaataaagataaaacgtaaaacatctttaacagtgaaactataacttttctccctctatcaaagtctgaaaaaaaaggaaataaaaaaatataacgggcttgcttttttaattaagcaacgttacttttttaagtaaccgtaattatacatagatgttatttttaaaaaaaatattaaggtaagtgacgaacattaaagttattcataaagttgcctttctcataattatataactctatcgtgtcaatttgtacagtatttaaatagaattttctatccatacttataacagaaggaaataaaaataaaataaatcatatttatattctgtaagtaaaatcgatttatagttttcaactttaattatgaaggaactaaataaaagcgctttttataaaagttaaacagtgtaaatactatgtttggtaaaattagaataagctaattgacttaataaaaatgtttgataagattaattgataaatatcaaatgaggtaaaaaaatatatttagtatttttaatatttaaattttatttttaataatttatcatcttaaaaagtaagatagtaatttttaaaattttgtattataaaaaaaatgatttttttaaaaagtaacattaaataaaataaactttattagaattctcttgtttaaaatcattttttaacatttaaatactttattaataatattattttaaaacaaaaaatgaaaagtgttttttaataatttttcttatatattcatttgataagaagaacttagatgtgtatgtttctcacttgaaagactatgaaatattatacaaatcatatattgtttagcaaggtaaggggttttttaaattgaattaaaaggtaaaataaaataggaatgataaaattaagaagaaaaaattaatagcttataagttaacttatttttgataaactatttcaaataacttatcaaaataagctatttaaagtagtttatgaaaaataagctattaaaataaactaatgtaccaacaaacttattttagttaaaggaacttatacgttacttaaagaaatttataagttccttaaatgtcttatcaatcataatcgattattctaatttatatatatatatatatatatatatatatatataagaactcattttattctcttataaattataaatacatattaaaaatttattcaaacaagaagatttatttgctgatactttctcaagaatacattgcataaaaaatgtggtttcatcggctagactatcaccctttcttgcgagttgcgaggattaattcccatcatcggtaacaaaacaaatataaaattacctgttaagaggagaaaatactatttcaattaaagataaagtatgttatgaattaattttgatggattttggacgagctaaatgagagggtcagctacccagcaaattttcataatattcaggtttgattagggttcataggaaagagcctttccgatatttgaaagaaaattgccattaagtacatgagtaaactatattacaaaacaataattagtgttttttagcagtataaaataaatagttttacttgctgaataaattaatttgtaagctctatggaggccttgtcatcttaatacaaaatgagtattaaaagatccattcaatatactttgcaatttccatgcatccacatcaaagatggtagcttgaaaggattctattatagcctacgcttttatccgatgacctttttttgtacgcactgattcttttatggttggggaggggattttgattatctctacgcttgaaattaaggatttcatcttcatgcgtgcatatgcttttattcaaagaaagcatgcacttttttttgtacgtattgattctttttttcttcttcatgtgagtgagggttttttttgtttttattttattttatgtgagtgagggtggggtgggggataatttacccattgattgttctgcatttgcataacattagagtgtgttagagaatatatatttagttgttgtgtaattgagagaataaatataaaaaaattatatcaataaatcataaataatcatataagaatgtattttttttacaaacaacccataaaaatgtattaaagagtgtatttgtaggatttctccatctattagtatgacaaaaaaatttgatgacatctcataagatacatacgaagaaattaaatgatatttgttactatttattgattatttaaaaaaattcttcccgcaaaaaatataaaattttaaaatattaaaataaataattgtatttttaattcaataattattttaatttatgagtatttgtttgaaaatgccaatttatccaagtgattaaagatttataatttttaccttctttatgagtgagttccaatttttctaaggtcactttttcaatttttccactttatgtgcgatcctcctctgggaaatcccccgatacctattggagtgtcttaccattgtaccatttacagtgtcaaaaaaatatatccatgcattgtaatgaacacttgatttatacttagtgttttatattgctttaaaagtttagtacatatttggtaataacttttgtagttttgctggataaatattatgtttaattttttttaaataaggtatagaaaaagattttttttatagataaactaatttaaatattcaattaactattttattgttaatataagttcttgatattttatcctaaacttaggaattaagttttcttaatgcttattttttccattatcaaactttatcttttagacattatttatacaaaaatattatactaattaaaaaattaaatttcagtaaaaaaataatttgtatataaatttatttatatttttatgttataaaagaatattttttaaaaaagtaaaaaatatcaagtgcaacacacttctccctgatttcacagtactctggggggggattatgcatgaaaattatatttttttatttctcttctcaagtaaatgcttaaaatttgatatgtgcatcctattcttgtttttttattttcttcttctctgtttacatgaaaaaacataaaataaaactttagaagcattggtaatcacataacggtatcacataacggttcttttaatgttttttcattcataaaatacatatggagaaactaaaaggctattttactaattctaattattcaaaaatgttaaaatattaataattatatttttaattcaatagtttctatttttatttataaatatttgtttgatggcacatgtatttaaaagtatccatgctttatataactaaaaaagtatccatgcactgtattggatactcggtgtatactttcaagttacaatcttttattgctttaaatgtttagtacacatttggttataacttttgctgaaaaaacattgttttttagttctctaaatatatggcatataaaaaggtttttactatagatagactactctaaatattcaattaattattttattattaatataaattcttaggatttgattgtaaactttggaattaaattttcttcatctttgagtcattatttattatttatgcaaaaataaattatttgacataactttcttttaattcttttttttaatcacaactattctctattagaaataatcatattcgataagattatattgagccacaaaactatccatccaatgctcaatatttgaattcaaaatctctaatatcagatgattcacatgcttaatgattttaaaaatattttttttttatctttctttcaattatttacatgaaaaattacttttatttaaaatactttgcaaaattggttcattcctttaagttacaaatataataaatgttgtgaatgaaaatatcatatttgatcggaagaagagatattactatatctttttttacggggtatattactacaactaagcaagtctgttttttaaataaagattattctcgctatcttaaatatattaaaaaataattgattctcgataattaaaaattagttacaaacaattgcaccgattttacttttttttttcctttgtaaaatactttttattaaaattaaatatcaagaatcaattaaataaaaatattaagtaatgtgaaattaattatatttgggaccactaaacatgacaattttcccagacgggagaaaataatcatgagaaaaaatggtgaatacaccaataaaattatttagaaaataatacttttggataacagagaataaaatagggaagatgttgcgaatgctaggtgttgggcatggaagagagtagtggggcatggcgaagaaaatgacggtggcatctgaacgaaaacggtagcaatcccgttaagttaatgttaattcttttgacgcataaaaaggaaaggaaaacgtttcttattcaaataccaataccaaatccaacacacctaacaagcttggttcgtattcattctctccttctcctcagaccaatccctttttcaattctcatagcatagatctccattttccaattcaaacccttttctctttcttccctttcttttcagaatacacatgcggtgttgctttagttattgtgttttagattttgaatatggttcttctgtgattgatttttaggttggtaagtcatctacaatctgcatcatggaaggtgttattctgagaagggtcattccttcggataacagttgccttttcaatgctgttgggtaagctaagcaatggaacacaggccctttttttttggaattactgctacttgtacaaattattccacttgtgatgttctttctccttccttttggttttgtttaattgtttcagatatgttatggatcatgacaaaaaaaagctgctgagttgagacaggtaattttttttttcgtgtattcagtttatttgtgaatttgcttctagtgccaaggggtgcttcatttctggctggtcaacttttgcctcaagatatgtttttatttttggagtaaaacatgttgttggtccctcaaaatatatagagattcagttttaatcccacaaaatatagagattaatatgtttttagcccctacattttaacaaaaatttcaaagttaaatatataatcttttctactagaaaaaatatcatttttcaaacttgaggtatcaaacacaataaactcaagatttggactagtgaaacatatcgtagtagtgttatcaatggcgggtggtagaacatggcggaagggtaaaattcctccatgtaaacacgccacagtgggcctctcttcacgaattgcctatggtggttggcaaaaaatctgccacgccatgacgcctcctttaacaacattgtattgtagaattcattttcaaatcaagagacctctctacaggattggaagcaggacttttcacccaactagttagagttcctccaaccgtgtcattctcgaagtgtgatatgacactgtcgaaaacaggaggttggaatgtgttgaagcatactataaaatttaatacatttttattccctactttttcttcaaaaacatgtgtttttagttcttgacaagagactaaaaccacttcacttttaataaatataagaactaaaacatgttgaatttttatagggactaagaccaaatttctagatattttgagaaatcaaaaacatatttttattctgaaatgttccttgtagtcgtagacatatttttattaaaattcagtaaaaagagattttggaaaactgatagttggcttttcaatcattaaaatggttgcaacaaatgctaaggatgagtgaaatacttagatattaatatattagataagatatatctagtacctaataagatatacatcttatcttattttctgttgtaattggctctatataaacattcatcctattattaataaagtaagctgcaatctacaacatttcctacatggtattagagcctaataattccaggccaatttttttctactgccatgtcttcttcacgtaccttcaaaatcaatgaacgcctgcattccgcagctgttgctcataccacttcaccagctcctcttgtggcttcatcatcctccacaccagcgccacttcctgatctcacacccgagatgatccaacgtatcctgactcttgctgaccaatgcaagcccatgtctgaacctttgtccaataagccattgtcctcctcttggcttattgacagcggtacttcccaacacatgaccggagacctctgtttccttacagatcttcgtcgtattgaatatttagttattttttatcttcatactgcatgaagaatttttcagatgcagctatgactaataaatgcgctttgagcatttttattttacaaaaatccgactttgaaatattatatatggctcaacatacctatttttcgctagctcttgttgttttcaattcctgacatgagacttaagtaacttctctggtagatctccatattttgtcatcaattcatcatatgcacttgtattatggtccatcaagccccatgctgtgctactcaatgctttccatgaaattacatgcaactaaaatcttgtcatggcaaaatatttttattttcagatatgaaattatatagtctatcatttaagaattaccagtcaagtggaacttttataccattgtattgcctaatatccttgcattttgagtatgttatttcattatttcttacatattttgacttaatatttgtgtgctatttgtcatttgacatgctaaaggttatagcagcaacagtagcaagtgatccacagaaatattgtgaagcatttcttgggaagccaaacacagagtattgtaactggattcttgactcggagaagtggggaggttagttggcctatgtttttcgtaatcaaggctattttaaataaaaagttagatggaaatagttaccaattttcactctacaaattggaactgctacttttggtgttactgtggtgagtgtatgaatgtgtggaaaattcatttttatttgaactttgaaggtgatgaaactcactcaaagataggttgatttaacatctgagcttttaataaactttgctaagataaatatattatggagtatatatgagtaaaatatattattttcctgaaacgcagagaggcataaagatttaattaaaatttgggaaattttatttaaacatctggatacccagagaatcttctgcgacaattgtttaaatttcagttttgtttctaaaattaggcttttgatataaatttggtgggtatagattttgtagttgatgaatttgacatgggtttcaaagggtatttcaaactcctactagcaaatttaacaataaagcactgttaactttttgttagtttgatgtgctaattaagctctatatttctttgtgaaggtgcaattgaactttcaatattagcagattattatggacgtgaaattgcagcatatgatatccagacaactcgatgtgatttgtacggtcaggttagccactattatgcaatctatatactctcaagttttgcaacctcttatgactgaacttttctattttcactttttgtgaatacttttgacaggaaaggaattattctgaaagagtgatgctgatttatgatggtctccactatgatgcattagtggtgagtaatttcatataccagattttttttttatcatccattccttctcttctccgaccccaattagcttgggttaaaggtattattgatgttgatgttaattcattccttctcttctgtgcattttttttttgtggttttggaggtgaattgtgagattacaagtgtatggtatttatatttatctactacacatgaaacaataaaaaaaattaaaaagttaaggttcatatgtatttttgttttcatgttgcctgatgattactcacaccccttgtatgggtcagatgtctccctttgaggaagctcctgaggagtttgatcagaccatatttgctgtacagaaaaacagaagcattggacctgttgaagggcttgttctaaattttgtgaaggaccagcagaggtagttcgctattcttattgaaccttcttaaaagaaagagataaatattatcatatttagataattgaattgcataaaatataaatcttcatatttggattctttatatatcagatttgttgtgaatatcggtacctaaaaggtcttctttttgggcatgtattttaaggtttcactttcagaggagttgggatgcatttgaatttcgaattggattgtggaaatattttctattttcagtaataattacaaaattcacctcaattcatgtttttatgtgcaaatatttaaaaacaaaaaataaagtgaaactaatgacatttttgtaattgttagtgcaaacagaagaagacatttttgcaaatccagtgcaccttttatcaatttagaacaagaacatagtgaatgtgccgcaaagctgttaatatatatacgtagactgataagttgaaaacttcaactttgccaatttctattgtcaaacaatacaggtgaaattatgcacattttttaagtgaaagagatagttgggctatgtatcttgtctgccagtaggaacgtatattttaactctgcaataatacaaagggaagtcagtttgttttatcttgcctgatgtaattttttttaatcttctcaatttaatttcgatatcatctcgaatggcctctcccaattatttctgctacttagtatcattatttatgctatgcccatgatgctaatatatcatggctacactttctcaggaaacggagttacacggacacttctaacttcactctgcgctgtggagtatgccaaattggagtgattggtcagaaggtgatccctcagtacctgatgctttgctttattctatttacccaccttagcctattctcctttgttctaatgattctgagtactttttttttttgaacatttcaggaggcagtggagcatgcacaagcaactggtcatgttaacttccaagagtatagatgatgcactctgttgatttgaatgagataccaagttcatgtgtaatctccgtggatttgaatgaacatcattgatgaaaggtagttgctttgttgcagacaataaaactgaataatttctgcatgagaattgttgtggcaacttgggttgtaatattagttccttggtctcgttccataatgactgattctaagaaactcaactctagtggcagactagataaagaaactaattagtagtcaatttttttttttatattctcttcctggtaaagatttttacctaatgtatttcacttattttccttttataatttttagtgcaataactacataaactcacgctactattttaaccttggccagtgttgaatgcttttgatactatatataaatcccttttaacgatagtatataacgactctcgaaacaaatttacaaacacttgttctagccgtcaagcttattgttaatcatgaatttcaaatgttgatttatgttgggagaaaataggtattattaataaaaacagtgaaaaattaagttgtgagttcattgtatttatataagaaaagaatatctaagatactcaaattttcatttatgtcatctatggattttccaacagaactacatatgtaaaaagcatatattattgtattgacttttggattcactttataaggacatttaagactaaggtagaggataagagctcaaaattaacccttggcccaatcctatggttataagaaattttgttgtgattccactgtgtaattgtgttctcaccctagtcttgacttcctcatatatatcattgattgtttgaagatgtgcaacacaaatttctttcttctttatggccctccacaatatctttctaagtatttgatcatatgtcttttctaagtcaataaagaacatatgaaaatcttttttattccaacgatatctcctcattaaatgctatagcaattatattgcttccatagtttacctccaaggcataaatctaaattgttttagtaatatgagtcttttttcttaatcttccctcaatcacctttttctcataacttcatcttgatcgccaataatttgcataatcttttttatatcaatattcttacaatttggtgttagagtatcactgcttcactcttctggaattttcttgggcctcatactcataaccttgttaaacaattttttttttatagaaatgtgccaactgatacctttctcccaaatcttacaataaaaggcgtaattttggtcctcgtcccttgtgtttaacctgatagaaatttacgtacttaattaaataacttctaaaagtaatttttctgtctttctatagtgtcttgtacttttgttccataacaaaaacaaagattttattgtcttcatccttagtgcacttctttttttatccaaatcttgactttttctctctaattttagcaagcctgtagagtgtagtagctctagctccacttttgatacctaaggcttggcataatcgaataaaagcttttagttcttgcttcagttcctttttggtacttttcttaactatcacacattttctagttttcagcattctaacacaagaatcatgctttaaaacaattcattttaatcttaactttatcttatacacttacattccatcatcaccaagatgttttatcctcaggtccccaacctcttgattcttcaagtgtcttttagctatttttccaaccctttatcccatcatgactttttctctttactcttttcccacacattaatgactaagattctgttgagtagtcaaactctccctaagtatcactttgtagttcatgcaaagtttttttttttttatacataatttccttgtaaaaaataaaacaatttgagaacaagtcatcccacttctgtaggcgataagaagatgttcctccctcttcctaaaacagtacttattattgcgaaatcataagctaaaaaaataaaatcaagtagtgaatattataatttttatgaagttcaataatgcatgtacccaatacaaatgctacaaaagctctgcaacaaggtcattatcacaatgtgtcagtgttattactttaaatttttaaccacgtttcaattttgaatttgttttaattatatacacacatctgtcgatatttttcttgtaataaaataatgatttaatccattcgcaaattgcggtgaatatatacttctatttttttaatgaatactcctatcagtcgtttataatacaagaagataaatgcaacatatatatcaatatcatattcatgggtgaggatgatggggaagtcaattttattttgaaaagcaattacaagatggtgatattgatatggtatatcatgtcaagtgaacattactcgtttactatactaatatcattgtagttgttagttttaccacttaccaatagaaagattgtcatcttgtaagcattgagatcgagtgggtgacgtattgtgtgcgtgtgcgtatacagggtgttcttttaaagatgatgaggcaatctatatggcatatgaacgtcatacgaaccaatgaaaaaatatattgcactacaaaaaaatatttaaaaccttatggaatttcttttgatcggtatattatttatcattaaataaataaacatccaataagtttcaatacaaaatttattaattgtcaatagttgtaatagaaaattactatagtgaacgcatataaaagcattatttcaaatatagccatataagtacttctgcagaagttattcagcgatactcgggagagggaggataaatctttttgatattttattataaaataaaattactaaaattaattcaatcacatttttatccaatgccatagtcaccttaaaaaatcatttttagtgaacatgtgacataaatttaaacaaagctattataacaagactcattcagtcaatttttgcctgtgaaaatgcataaattggctttaaatttaaaaaaattatgctactagattacctgtaagtagttttttcttatgttaaaaatgtctgtcctaacttgactgaattggataaaagtatctttgcagtgtagatttttttgttaattttttttcagatatgacattttgagctttttatatcaaataaccaacacaaaattttaaattattttatatcattcgtcatttttaaaaaaaaaattgagcaaataattcatttaaaaaaatactttaaatcatatgtagtttttatatactattaattaagcaaaataagagaatattataaaatgaaaaggtaatataatccgagtaaattatttttaaaattaaagagtgtttaattacttttaaatttttgtacataatcttaaaatgatacttattttaaagttgaggaatagtaatttgttgttataatagtcatattttgggtttggacttggaagtactgccggcagactagaatacaaacatttgtggtaggacttaggaaataggagcagtgtgaactcaaaacttgagatgtaattctatccacaaagctctcattaattcatgattgatcaaccaccaaatttcgatagtgacgacaaagagatttagttgccctaggaattttggaaggttttacaccatattttagaaaaatatatagaaagtgtgtaatgctgaataggcatcatacctactactccaagcttagcattaaatgatacaaaccttagttgtaggctagagcatttgcacagtttaatctcatggtgttgggtccatgacttgtacttggtccaactttcagatccaatttccaaatcaatctttttttccatcatgtgggacatgtatgataaattaatagtgcaactcatttcaaaattgccaatgcactgcttctcttcaccccattcaattaatctaccatgttttaattcccatatatgtactactattcacagcactgccatccattgtcatactgttttactaattcaaagatgaaccatatgtgggtaatattaggcaacgtatcttgaaagtgatagcttcccattgtttgttgaaaaaaatatccatttttgtttgaataaaaattactcgcgggccctaattaatccaccgtttaacgttacttcatacaatatgtaaaaaataatgagtcagcttttaggagaaaaaaaatggtaaacatagtccaagtcgattagccatcaatcagaaatatataaaaaaaatatttgtaattttttcatccttttcgaagatcttaccaagccttaaaaaaacaactctccttttctcgtcaacttcaatgctgctattatagagactaaaaaactaataacaaattgtgaaagcgaatctcacaaccattcattcacgccactcgccactcaagttgaagaatgaaagtggtggccaccctggacacaatatgtatggtggagcagatagaaaaacatgttacagaatctcatcacatttctcaaccccacacaaaaatttatatccctatatacagtcatgaacagaacataccaatggagttcggtcgagcaaaagaatcattcttcacaataagtaaatcaaaattcgaattcttattagaaaaatatattgttttattgtggattattatctattgaaagtaacacatatcagaaagacaaacaaacaatttaattgaaattatttttataattcacatatatctttcattaaagacaaagcatgatctaattaagtaaaaccaccaatattcagatagcaaaagtctatttctcaaaaaataataattaagatgaaataattttgtatcaattaataatataaatagaaattgagaaggacgagaaaagtaaaaagaagatagtagatcaagataaatcaacctctaatagtgatatatgtagggtatagcatcaaaagggtactaaagttttgtatttacaaaagaaagaaaaaagtgtaagcacccatccacccaccctggttacaatattaacattcccctagaagcacagaacaaaaacaaaaccctagtttatgatggaaggattgagccaattaataggcccaatacactgctccaatatctaattaattaagttaatgatcttctggaatgctttgaagagcaggcctccatggacgttgaagagagtgattgatcatcaagtgcgccaaaacctgttccattctcaactccttcacctccactttgccaaccaactcctccaactgcttcttcgttatctttatcttcacctctctcctccttttcttaacaccgccgctctccgccgccggaaaatcctcccagtcctcgtcctcgtcctcgtcggtggagtatccaatccgcgattcgcgcctcaagcagttgcccattttgttttgtgtggctttatgaattgcaatgatggaaagtaatagctaagtgggtgatatgatattaccaatatatagagagataggtaatgaaaaaattaaatgagaaaatgggaaaggtcaaacctaagtagtgccacgtaggatttcctaggtggcaagtgtgggcccctttgactctaacggacttcaagttcaaggtatcttacgggatcacattctagccgacgcttagacttcgactggcgcggctctacttgcttttgccatcccaataaaatgtcttataaataatgagaatgagccaataattttttattttttattttttatttatctaaaagaatcgtactcaaataccaggtgatccacagtaactcacggacgtaagttaactttcataggacttttgtaacactatttttattagccaggatgattttaatttaataaatcatttcgagtctaaatttaaatatataattgagttaaatctctagagaaataattttctcatcaatttaaatttaactcgagtgaaattatattttgtataaaatagttgcattctaataaaaaaaaagcaagcccactattattaaattaattacgttatttatttcactttactataattaaggattttttctaagtctctaataaaagatatttgtgatttagacaaaaaatatatttcttctcaaggttctattcaatatattatttattttattattttatacctgaaaagcaagtaccaagtagggcgaatttttttggtgcatatacagtaaaattaccagatattttctgaaaaaaataatgagtcaaaaattgtagaacaatattgaagcataaatactgataagacgaaatttagatacaatttcataaatatttttaattaaaattaaaggtttatttcagtaatttatattaatttttaatgaacatatttattatttaaattgccgaaataaaataatattattaaaaataattacagaattgtatttaagtttataaattgtgtatctttaagcaatctagtggcatgcaagccatgaacagccgcgaagcacaagtcaagcccctcaaagttcaccaattaaattattattattatttttgtcatgcagacagcaatgaaatgttcaattcaatattgtttcaggtgtgaacatgggcatggtaggaatctagcgtaaacttttttaaatgaattatctatattcttttcattatttttaattacttaaaaaggcatttccaaatagacaaaaacgaaactgggcatttccaacaacgataaattgttgccaaagaatttttttctccttgtatagtatgtagaaaaatagttgttatataattaaactcaggatacaaatctcattttcatttcccttcaaattgtgacaaatgatcaagaagctcgtgttataactttatatgaaattagatgctactataaatttattggaaaatgcctttttatgttatgagacaaacctagttgtcttttttatacaaataaattatagctatttaagtatgcggttaaactttaattttatattccatgtcagattttgatcaaatgtgttcttaaaaacacacagcttcatcaaaatatatatatggagggatcataaagtgataataaaagctggaattagttggtaggttttaggtgtgaaaagggtataaacctggaatctgaggacaagtttcaaatagaagtagccacgtcaggtgtgaacacaaattagggaacggaatctttgagtgaaggtgctgtttggctaccttcctttcacgtgcaatttctatttggctgacccaaacacacttttttcattatcataaccctaattatatatgtagcttatatatactccctacacgactcttgtggaaaaatgatcaataataaacaacgatcgttaaagaacgcttttcatttaaacaacgacatagtcaattccataattattagttatatagagttattttttatttggattccatacacactgtcaaaatcgatcggttttacctcctctgttcctctcagacctattctcaaggacattcttgatgcgttatatatatcagaagccggaaggactacaacgatgcgttacataacaccgtaattacttcttcctttaaaaaaaaaaaaaaagagatagggattattttaaaaaaaattaaaaattataggagttatagttatatttttaaagaattaaattaaaacttattatatttgcaaaaactaagaatatattaaactcaattttttaataggccagtgcgatggttgaaaaaaatatgtatatctatgtattgagtttttaatgtgtttaaagattttgaatgatatagtatttgtttagtttcacttgggatgttttaaaattatgttcaatagcagttaacgtgatttcatgtaaatttttatatttatttaattttacttttgatgaattgattttgagtagataacttttatatgtactaagtttcactactaacttgcatttataattaaaaaaaacttaatatttttaattaaaattaatatgatttgaaattaattttactaatactcatcggccttatcatagcccaatgcccctctcattcaacgatcatattcttacgcatataaaattcatgcaaatacaaaagcacgagatgatgaacacaatttattaataccttactgcaaatcaagggattaaccttaaagacacttaacatgcgttatcatgcaagagacaccatcctaactcaataataattttagaagtaaacctaagaacatgttccagtcccaagtaaacaattatctctataaatttacaccctttatctactattgcaaatactaacttaatcgtcaaaatcattgcaagtgctccatggaaactggactagtacgaagaaaatcatatgagatttccaaaatccaccttaaatagtctttgccttgagctggggaagaacaaatatgaaactaggttgttttgtcacaagattcttttcgttgccatttcaaacgtgctatcctcttattgaatatgaataaaagcgaatgttagcttatagtcaaccttttggcttttagatagttaaagttaaagcaaattaaagcaaatttgcatagcacgatttcgaattgtaataagtatatctctatctctatttattattttaaaaaaattataaatttctaagaaactttatccaaaatataagtaaatttctaaaaatcaaaaccttgaatcattcttgcacaaacgcgaatgctggatcacgtgctgcacccatgaaatacgtgcagccactcatgactttatgtgtgcatgcaaatgttgggcgccatggctatcttaatctcccaatggcttattttcttttctagggccatttcattgttgttatatattatatggtcaattcaaatatgacttttaacttgtcgaatgttgactactatcttccctttgtttgacttctaagtcttaattaagcagcagttagctgcagactctagctaaaatattaatgtttttacttggctttcatttgacaacattgcagggttaaattttaaatgaatatcatagtattttgcccaagacttgtgtagttgtgtacctgtgttagtaattaactaatcaaaggaaaataattggtttctagtagctacctaattttccttaaatattaattaaaaatcaccgcgtgtaactgatgttgattgctcgttttacaactactgcgtcaaatgtactactctatttcaataacggccttaattaattaggacttgtaaaagcacaataggttatagttgaaattttctactttccacgtttaggtgtatcaaagttgaataatcaaagtaataaacggcgttatgttttaagcatggcatataagaaaatatgaattataaaagttaaataagtcacatctgagtgagtgtaatacatgttggactgcacaacatgtcaactactgcatatgtagcctccattgacattttttttatcaaacattaataaaaacattactacaaatctttagtaacattaaaaattatcgtcaaatcataaacaaatattattaaaatatttttcacattatatcaaaattgttaaattcttttttaacatttttagactttaacaacatgggttatacctaataacattggataaaatgtcgcaaaaatatattagtaatatttatttataatttaactatattttttaaatattgtcaaaggtttttaatattaagtgatagacaaaatattattgggaaatattacatatatactaacgcccgttgattttttatgtttgttgttgatgagctttacatttttgtttttttaaatgagacaataataaatatatagaaattgccttatagaaattgtaattagttaatattattaatttgtaaatatagttttttaggattaatttgtagtcagatacttttgtttatagatcagtaaatttacactacagtcaatctattacattcatattaatgttgattacctgttttttctttttcttttctaagcagtaatataaattatatagagtaaaaaaactactctagtccatatctaaacttttagtcagaccaaaaatagttaagagactccaaaacttacatcattgcatattaatgttagttactcttgtataaacaggacttgggagtcccaattaattcaacacaagaagattgtttcaagaataactggccgggttaaagaacccaaaaaaaaatctccattctatatattcatattaaactgaatgtactaatcaatgtgtgctgaagaatcatgttcggaaaaaagtagattttcaatacaaaaaaagaacaattttgagtcactttttacattttctcttactctatcttctcctttttgttttatcatttcttttaaattaaaagaaataaaggatgtaaaataatttttattttagtttcaaagttttcattttaaacattaagtttaaagtcaattttaaataaaaagaaaaataaaatttgaattaaaacacatgcatacaaattgcattgggaaattgcttgatataaaaataaaataaaaaaatttactggcaatgcccgttatataggacaaaaattcaatataaaatgaatgttgtaatattcttcaaagatatatacatacaaagacagagttgagtggctatctactatatagtgtaatggctatgttgcagttatcaagtgatcatcgtttgactctatatcattaagtggacccctatctttttcttaaaaatataagaccacaaaatgttttaaaaaattgtttgccgacacctactaattaaagacctcctttttttatcctttaatctttgagagatattacttaatatgtagagtgtagactcaattcctttttttattcggttgagttgaataagttcagtgagtttttttttataattcagttcagaccagaccattgaggttgaggttacacttatttcttaccctaatgggcttaattctgagccgaacttataagcccagagtattttacggtcgcctgttgtggaagacaaaaagcccacgacacgattgagtttacgtactatgggcctttggcacagtccaagaccaatgttacaacccctgtctctttttttttattagatacataacccgtctctatctcttcacaaaaaagttataaataaataagccaatccaattttagttctttttgtttatcaaaatttaaggcgagaggttaaaaaaaaccttaataaaatatacttagaaaaaaacttaaatttatcacatttcaattatataagtaaaaacttgaaaaattacgaaatcctattttactgtatttaaccatttttttcaaaattttcaaaacttaatccttagttcgttgttaaatgctaaacaaacaatagctcgatgtaaagaaaaaaaaaacgaacaatttccttgaagaaatgtatactttcctttgtgaacttccctcgttaggaaaaccaaaatgtaaaggaccaattccaattataatccaaactaaagaaaagactaaacaagaatcctaatctcatttttccttttgcccgaagaatgcatcataatctttatgtactgcaacgcatttatttcacggattattttttatttttgaaaatataagattgaaaaatattattctcatacttattatgaggtaataaaataattattatcagatatataatatatttttttaaaatacttgtgaataatatttctctgtcatattctcaagaaaaaatattttcagaattaaataaataattagtgaaacaaacgccctgtgaattgatttgtttgttagtttgaataggtaaaaaagttgcaactatacgtaagaaaatgataagaacattaacaaaaccaaggagctaatcacaccacacacaaaaaatctcgtaaaaagctgataacaacgtaataaatatattatattaagttgttttaattacatcattacttttaactccgacttttaatatactcaggtggaaaaaaaaaaatctttttaaatccaaggacacatacccaaacggaaattaagttctcatgtaacaagctacaagctacatcaagtaagaagtgtaaaacaattagtttatacggacccctgttgtataatcattgtggcttctggtataagataaaagtgcaaacctatagctataaaaatagaaataatgacactaaaaatggtattgtttccataaagtagtgacccaaacttttctttctaaaggtactaaaaagaagttccgtgtttttttttttatgtacatatacgaaaaataaaacagcagcaagaaaaaaaaggaacacaaactagataaaaggggctttttagtttgtgttaattggaagatatcaatcggaatatgcatttctaatgggatttattccctattaagaggtaaagcttttgtttgaataaactttttaataaatatttataaaaatataaatataaattgaatcaatttttataagttaaaattaacttatatattaattaaaaagtatttataaaaaataaatgaaacaacttttataaattaacttgatttattttattttaaaaaataatctttagtacatatatattaaaaaaaaatataacactaaattttatattatcaaggccagttgattcatgccttttttgataaattgtgagatattttaatttaataaaaagtaaataatttgaaatttgcacttttttactttatacatcatctctctaaaatcgtgaaaaaataatacatgaaccatatttcatgacgtgtcacccttagatgcactatttttttgcaatattctaggcgttacattccaggcaaactccaacacgaaaggtgatgggtttaatgtgattttgattgggaaatgacgtccctacccttcacactttaaaaggtggtggtaagttggggaggggcttttaagtcttttcgggattgatgccagcgtagagagataaactgataaagcatgattgttcagctccaagggtcgctttttttgcagtgatcaaatcctcatcttctctcaatcctcaaccagcaacctctctctcttctgctatcactctctcactcagtcacttggggtacgtattgttgtgttcttcattctccaattgcacgttttctctcatttctcaattcaatttctcccatttccctcttccttttaacctgtgaggaaaagggaattgtgggttctccttatttcagttcaatttttcttcttagtgttaaaaaaattacctttattattgtgtggagattgattcctgtaatttgttgaagggttgaagatgagaatttgtggagcaggtatgggttgatattggatttcctttaatttatttggtggacttatttccttcatgtttatgcacccaattctgggtcttgtgagtttggttttatttttatgtgattctgttccaattcccaatttatgaatagcaatggatgcacactgggccagctgtttgcatgagaaaatataattttatttattggcacaatctttgacccaatacggatttccatttattggaaattctatgaaattggaatcttatactatactacttgtcttctttttcttcccccaagtgagtgctaatagttaaaccataaatcacttctatatttcataacaaggatttgtttttctctatttctgtctgattgcatacatgcatgaaagaaagagtatcggctaattgttttatttgaataaaaaatagtggcgtgtttaagtgttaaattagtgttcaatagtaggcacagttgtatgtgagtctgcagcttgtaaagttgtagtccatgtttgggggagaaaacacatatactataagaaaaaatatccaaaagttagagggaggaatatatgtgattaggactagaacataaagtgatgtgatgggatgggagtttaagttatttttaaacctaattatctttataaaatttaggacgtgtttggtttcagaaaatatatgtattcaatttttattttcataaataaatataaaaatcttatcttacatttactttgtttactattttccatgttctacaaattattttggttggtcctagcacaaatccttgacaatagggaacaaagtaagcataagatgatatttttgtaattatatgtgagaattcaaaatgaaaacagagaataattattttattagttcagatgatccttgattcatgtaaaacttttatcattaccatttaccaatatacaagtgccatgtggtatagtaataaatgtagcaccatatggatgagtgattcaaaattaatttttaaacttccgattatctgttcaaatttgtaacttcagttgtcttggcatcctgatttggtggctcttttgttttttttcatatatacaagagcattttgaagttgattatttcatttagaaaaggactctcatgttactcaaatgcttagcagcaatcagcagcagctacaccaccacgtccaatttgcttttagtgtttgcttcctcttccctctccagtcctgccaaaaccaagttcctgccctcactttctagattttctgtcaagcgtccgtgcttcctttcccaaactcgtcctcacattgccgtgaacaagccctccatgaacctgttgaacagactcgggtttggcagcgcaagagcaccagagaacatggattcatccattcctcagggtccagatgatgacataccagcaccaggccagcagtttgctgagtttggtgctggctgtttttggggtgttgagttggctttccagagggtgcctggtgtgaccaagacagaggttggttacacccaggggcttgtgcataatccaacctatgaggatgtgtgtacagggaccacaaaccactccgaggttgtaaggattcaatatgatccaaaaagttgtagctatgagactctgcttgacttgttctgggctagacatgatcccaccacactgaatagacaggtatatatgaagttttttattttttttattttttatttttttatttttcacggtatcatgtaaaaaatgaggaagtctggtttctaattgatatttctagattttgctgatatgaataataggtctggactttgtgtattgtcagcataaatgatttttgttacttttggggtttctgtacaattatttaatgatgcattacttctagagttaaacattttgccaacacttttttgattccttgattgatttatttatagtaaattagtaattttggttttctctatgtagccattatttaacagatacatttatggtttgatatctagtcatgtctgttttgtaaattctgttttaatatgatattgtgttgaattttgggtcgcatcaaattgcaggggtctcttggtaatagttgtttaggttgtttttacccttctgtttgcacttggtgggatgtttataggggtgtaacgtaatagatggttaggataaattaagttggattaaaatagatggttcaaaaataaaccattagttcatttatgatgtggtagaattttattaaaaaaaaatccaaaccatccatgactttatatgataaagaaaaatcccaacccatccattaataatgtttcatgggtaagatatccaatccatccatttatttattttttcctcttgtcagcaaaaactctcttattaaaacatctcttcttatgagcactgttttcaaaagaacctgcaatgaaccccagctcctatgattatcattgatccaatatcttaacatccgatggattgtctcctttctttgtacattctgtaactccatttatcagttgcatttaggagttaatgcaatgatgattttgctttaatttcagtgtggcaatgtactagttccaacttcttatgttggacttcaattatacatggctctctagaatgacttgtgagcatccaaaaataagtttccatatggagtaatctatttcagtatttcctttgctacatttttgtcttgtcccttgtttcttttgttctcccctttcaatatgcattcttaataattttgtttcttgaattcactcttccatccaaatccatgcacacacgaacttttgaaaatatggtgactagttatgatatgcagcagcacatacatggattgtacattctaccgcttaagcgcttagttaccatttgatcttgttgtgtggcaggggaatgatgtgggaacacagtacagatctggaatatactactacacgccggaacaagagaaggcggccaaggagtcattggagcaacaggagaagcagttgaacaggaagattgttactgagatccttcctgccaagaagttctacagggcagaggagtaccatcagcagtaccttgagaaaggtggccgatttggtttcaagcaatctgcttctaaaggctgcaatgatccaattcggtgctatggttaattgccataagtgaattgccttcaaagatcaatgcaaccggttcttcagatattgaaagtccatagttttgttagtaagtatttgtaaatatatcaacaaagcttgtgcacactgtatttgaggttgaagatggatatagccatagagttgtatattgtcttttatatataatatggctttgctttgaaatattatctccacgacctttagttagtgttccgttggtgagaaatagaagggggaatggaagataagtattattataattttttatttgtttgatccaaaattttggagaaggtagttgaaattgttcactcaaaattggagagatttgaaggactggacaacttttacattaggtagactaaattatcttttaacttaattttatttgaccatgttaaataattttctcctcattcttatgaactatatatcaggtgtatttcttttctgtcataatctctcttctgtcagtttctttcaaaatcttttcttttgaaagaaactgatagcattgtctatttcattacgttcccttatataaatttatttcttgattagtaacacgacatttttttgtttttgaagtggggttggggggttaacaactgaacgtatccttttagttagagattaatttcttcaagttatagaaattactaatgtataatttgtttctttcaacgaagtagttttagttttttattgtctcgttttttttttctttctttgaaacattagaacgtgatcttatgaaaaaggcaaacttcattgtggtgggaggttagggaatttggtggttaaagtaggatagaataaaataactatcatatttaattgtaattaattgtttgatgtattggccggatatggttatgttatctttttgtttaatctatcctgttaatttagcgtaatttttatcttttgaaagaaactgagttagaaaataacatgacatcataatacgtgtatctagtataaaaaataatatataatatataaaaatactatatataaaatatattattaggtataatatatatatatatatatatatatatacacataaaccttaacataaagtaaagtatattgtaaaaggtaaaaaaaaatattataatttttaaaaaatacaattttaatataaaaaaatctataattataaatatttacatgatgtgtaagatgtttgttagttaattattattttcatatctgtatatactcttgaaaattttgtttatctctttttaagatctcttttaaattgtctttgcattatttttttatcaaattaattttaattattttacaatttttgtacttaattaacaataaatggtacaaagtaataagaaaaaaatatttttttctcttgcgagaattggaaaatatgactaaagatgttaataattaaataggaattaagtgaaaagaataaaagattatgcattttggtaattttaagagtaattttaaaaaaataatacaaactattaacaaatttaacatgactaattaaatttctaatttatctaattattgtgaattaattaaagaatattatattaggtacaaaagtagtagttaattacttaaattgttttaaaagttggaaacgggtaattgttagtggtataaagaattaaaaggtgggaaacaaaacaaaaggaataaacactacaagaattccggctattacctaaaacccactgtaaatcaaaattaaattaccaacgacttacggtaggctacttatccctctactataatcttgttgatattttgtttatcgacgatcatgaaaaaccctaggtacgtaatatagtggactaaggctaagctcattgtaattcgaggaaaatacaatgtgttcttaatttggtcagtaatttaaccttcgataatagcaaaaaggaaaagaagttagtaattttagtaaaaaatacattcgcagctagctaattgttaatgcttaatggtggtttagagcagactaactttggtgaatcataagtttttctttgctggataaggtgggaaacaaaacattaaccattactaaagattaagattaagagtatgtttggaaatctgaatgttccaccacatcttagacattactaattatatttactagtactgtattatatgcataagttttatcagattattttcaagagtaaaacgtggtgaaaaaaaccgaaaaagctgtgtaaaagataatttgttaattgcaacgtggccttttctggtcggaatttgatcatatacaatattcatattcatttgtgtaattttgactgtatatattaaaatattttattgaagataaataaatattcatattcattttttttgctgaacaaaattataactatcggtaattatcatttcttttagaattatattattcatataaacaacttttaaaataatttctataatattttttttctttctcattcatttttaccatatgctgaaaaaaatagtataactatgtagtattttcttaattatataaatataatctatctttctaacgaaaagaatatttcatcattgcacgtgagtcctgacacgtacatagtctattattttatcaatgctgattatggacatgaagtccccactgaacgtgggctcttgttatttccaattttccatgcatgtagacaatatatgtacatcgtgatcctgcatcaactggtatttttcacattatatattttcatgatactataatataataatcgaaaaaaatgtctatattgttcgataaaattaaagcaacaataacctaaaagtttatatagcaaagcacttgaacgattttatgtttacatcaattaattttattgttcaaaacaactactcaggttacgtaaaaaaaaaaaactattaatgttaattaaagataaagagaatactttttttgagagtaagataaagagaatacttaattaataagtttatgagtgtgtgataaacatcaaagaatattacccatgatgaggggaaacaaaaagatcttaacctgtcttatttcattcacatatttatacaaataaatgaaaaataataacggaaataaaaataaatagtccatttttataaatatttaaaatatcttcttaagatcacatctttagcgaagaaaaataatcttctatcaaaggggaaaaaaattcattaaaggaatattactcttaatttcatatatttattgaaacgaatcaaactaaatcaaacaacaaaataaacatttagaaaataatagcattcatagtaagtaataaatatatgcattttaaaatctattcaacaaacattttctttctgaggaagtccaaccttgctcataatttagaacaaaaatttaaattacacatgctccaaatagaaaagtaaaaaataaaatggtaaagaatcaggtataaattaaatttggacccatgatggtaatgccccacaagagcgacgagccaagtagaacctcacacattctgtgaatgtatcctttttctttcagtttctgcccatgtatttggttggcacttcggctttgcatgcattgacaatgtaaaaattggaacacatatctcgttctaccttcgaaaaaatttataagaatttatatccaattggttgtacgtattttcttaatttacttagcattacttgaattaaagagaaaaaaagaaacctaacaatggcaatgaaaatgaaaatcaagttaggatgcgcagccattaaccatttttccagttgtttaatttaagatttttaattttaataagctatccagatctaattctgcattgaagtcgtaccaaacaaagaaaaaaataaagttatcacttattatgccactttatagagggttggctcattaaaataaatagtattaatcaatttcgaagcccatgtgagagcgtatttttttaatatggagcattggagcgcacgttttgtatttatcgacgtgacagtctctttggttgccacgtggagtctccctcggatgcctttttgtgtagggcgaaacagagtagatagtgaagtgtgcaagcaacaaatagatcagacactgacgacacttgctttactatgaagtgccctacacgaccgactcctcgcgcgtgatcaattttcaaataaacattatgcattttattgaagctgagtctcacatatccaagtgtcatgaaaatcggttggattattgaatcagtcgaggtaagttgaggtagtggataagtgatttagtggtccaaccgatgaatcattaattgaatcgatttaaattggtatatattaaaaatttaaaattatatatgtatttattatatataaatatataactaatattatttgagtaaaaaaagttcattcatactctaaaatctaaaataactattgataataatccaaaatttttaaaaaaatccaaaaaaacacatataaaaaaatcacataaaaaaatcgaacgaacttgatccgaccaattgagtttgaccaaatcaactgtatgatcaatttaatgacagtaccgaaccatttctcgattcaaccgatcggaccagtcgatccgatcagatttcaataacactacacacaacaataaaattgttttgattttgaatttgaaaataactttttacatataaaaaataaaattacttataaaattcctctctttgcataaagaaaaattcaaaaacaatctcttttaacaaaagtaaaactgcttacaaaatttatcttccttatctttgcataaagaagaatcttttgaacatctaaatttttttagttatatgcatttggttcgagggcgatgtctaacgttggagacctaaaccgtgggaaagaattactgtccattagatctatatgctttttagatatgtttgggattatcataggtttacacacattagaacaattttcctccaatctcaaccatcttcaaggaccacgtcgacaagattttcatcgtcaacaacgccaccagtgttgtcgacgacatcgtactccaacaaatcgcttggaacttttgtgaaggaaggtacaaaaaggtgtcgtcatccgcgctctactacacctttggttccagttaattccaacaatgagatctaaatgggagattaatccttctaagtttacgccttttgattgcgtgcactgatcttcgacctggcgtcgatgacgcatgctagttgtcgcggatctggggttggcctatccatgaaagagtctcaaatttcgcttcaaatttgggggttttcatgaatgaaagcgtttgtgttttttgtacgattgtttttttgctttggattagtgtttgaggtttggttcatatttagatttcacttcggatctgcgctcagtggttggagaaggagagcgtaagaaaagaaaggaaatgaaaaactgaaagtaggaaaaaaaatgatgctgtgagaaatcatctccaacgacgactaatagaggtcgacgatgatgctaatgaagaagaagagtcattatgtaaaaaaaaaaatagtaaaagaaaataaaaattctaatatatgcatgtctatcatatatctcaaaatcacttaaatccaatgaccacggttacttacgcacagtgggaaatctaccttactttcccactgtagacgccgggcatggaaaattgtacccttttcttttctggatgcttgaacaattattatcactgatctcttatctctactttctgaatttgacttgcactaagactttatcaatactatctgaaacgaataaaataaacataatattttttttaattcattactatgtatatctcccctagtttatataagaaataagtaaataaacattgtatactttttatatcaattatgagaaatgtaaatatcttttctaatatattaaatgttaatttttaaagccttttattttataataaagtttgttcacaaatatgagtttaactcatattataaaattattttatattatcaatcaattaaaaattatcattaatataattttaaaaaattataataaaattcaataaacttattatatataataatttataattaaataataatataaaaatactttacaatttcaatgcataacttaattattttcttttacaagatactggtgaatgtgatttgatttaaatataaatttgattagaaattttgatttgtaataatctttttcattttaaaattaacacattcaccagtgaaaaaatatttttaaattatgaataatatcattaaatatagtcacatcttaattaaaccattaattttgtgaatatttttaaataaaatttaaatttatgtcactaataattaatatgaaccaattagattgtttttaatgcagtgtgtatttgtttcttacgtgaaaaacaagaaatagtatttatgttagtttttctataaagtcttctctgttagctttaacaaaacagcatatgttacactttaagtgtttacgtgaaacacgacacatttgtatgaactgttttaaagagtctagttagagttagatgtaaaaagtggtaaaccctttacgtatattatcttctttgttttttgacgaaatcaattttatcttaacatttaacatttgttgtcataaactcagtttgtgaatttgacacctattgtggtattattttaaaattttgacagaattaaaaaatagtctgtgaagtttatatttcatcatttatagtaagtcagatattagtccattatattgtcttcaatggagtatcaaattgacaccttaagtgcctttcaacacacggaataaccttcatatcttagttaatatgatccaagttttgtgctctcatatttgtcgcacttttaccctatccgacttatattatgtggctactatatatacttttaagggttgaaaaagctttggaactcaatagatttctctaactaaagtgacaatgttcacgcctcaccagtttatcatttttcattcgtgaatgaattattctttgacaaaaattcttaataacttatagaaatagataaaattatggagttgtgtattttttttaacagcagaaaatttattaaaccaagctaagcacaagatgtgccaaagctataaaccaccagagtacaaagacagcttttgccacacatatacattattaatcaatcataaataattttaaatataaatatatattttacaaaaaaattgtacttttagtttcttttattttataggcgacgataccatagtgttatatttcaattttcagacttgcagggaaaaatgaaaaaaatcaacaggattttttctttcaaatttggatttctaatagtttttgtttctaatttcattgattcctgttagatgtttttattttctgatttggccaatggccaaaactgacgatgacataaatgtttgattgcttcattaattatatactcattgtctacgagaataacagtaaatcgaatctctatgatatgaaataaatataaataaatgaacaaatccacctcttttttaagtaatacgaacttgtaattttaaactttttttagaggttgtaattttaaaccttatcatttttttgcaatgtttggattatttcaaagtaaataatatacattccaatttgactaaatgagcaataagtaaaattgggtttagtttttttttaacttttttctttgattcacaacgttgaatcacttttcatcatcattttattcaattaggttaatttaaaatttaaattaaatatttctaatgaaaatttaagtatcatttcgtattcaaattttaccaatctaagtctatattttattttataactaatatttgaattagtacctgcattgtataaaataaatatttattttatataacaaaaatttacagtgaataaatacttcaaatttataaaaattattttaaaataaatattcttaatataaaaattatattttaaatttatgataaataatttatagtgataaaatattattttaaattaataataatttcttttacaaaaaatattaaaattcaaattataactaaaaatattaaaaaaaagtcaaattaaccacataaatggtaaaatcaagtttttattgagtgattaatttagatactgtatttttgtcatccgtatcaatagaaaatgtcaggagaatttacaattactcccttgacatttactcatttagatattatatatctgattttctatattatgtaaacaaatattattttctctatattatattaacaatatcttaaatgaaattatctgttaacaaatattaatttagttgataaaaaacaattaaaaaatatcctaattcacacaaaaaaattaataaggaacaattaaaagggtgtgaactctaaaatcttgtaattatgtttgaaagtaataaacaataaaagataaaaatgaataaaattgatttgaaatgtaaattgatccaatttttaaaataattatatttcattatttaaataaaataaatctttcttgaactcatcttaaatatcttttttcacatataaattaattaatattttaaagtcattatccttgaaataaatcctaataaataaaatgtaaaagtaaaagaaaccccccaccatccttcgatcattcaaatcagaacgtctcttccaccagcagcctaacaaacatcgtagcttataaaccaagtagggccaaacgacatcgtataacattttcccgcgcgtggaatcatgataactgatagcagatacgttgaccgtataaacatacggaaagacgtacacctctttgcgtatgtgtatttgtattgtcactgtgttcgtccttttctcagcaaaatctctgaaacagtgaaactctccctctctcttctgtactttcctcgtgtcctctctctcacacacacacttcacgaactccatcactccaacgacacacagattctatctcctctctctctctcacacacacacacacacacactctctgtttccattttatctctttgggccattcattctcgcaagtaactcttgtttgtttgattaaatggctgagactcgccggcgacgatgatgttttccggcaaggggagttttccggcgggcattgcttcgaggagcgtgaacaacccttcgccggactcagatcttgaaccggcgaagccatttctgcgacggaacccgagaactccggggacacggttgaggagacacggtggcaaacggagcagacccgaaacccctcttttgaagtggaagatccattacgatccactcgaagacgaccagaagtcttccgtcgctgggtcccgccggagaacgtgccggagcgccaagaagcaagccgaagtcgccgtgtcggcgaggagactagccgccggactgtggcggttgcatctgccggagacggccacgggtgatggccggaaggggttggaacataaggtaggttggaacataacttgggctactcttcttacactctgggtctggacctaactcagtcgcaaaacctagtttttgctgcgagggttttgctctgcttatatacactgttttgcctatgacactggtcaatgtgggatctcaaacgtttacccttttgtttttttctttctttctgttgtttgagatccctagtttttcttcgttcccgtgtgagtgttgttgcatcttgcatgtgtttgttgtttttgatttaaatgtgattttgcagctacatgctactatgttacttcatctactgtattgtaggccacccctcatggagaaaaaagaattaatagtttattgttggggtttatttattttcatatgatgattttgttgttgcttgattttgaatcgtgggtcttcagattctatccttggttccttgtcattattgttcactttcctgttttggtgttagagttaggggttagccgattaggctttctatgaaattaaaaatagctgtcttttgaagatacaaatgcttttgtttttttagttttctcgcgagtgatgtagttctagtggaggactaattatagtctttgtaatgattggagaaatgagttgagttgggtttgtgtttgtaaataattatcgttatgttgaagatttcttccctaaacgcaaacttgtgttcggagaaaggaagaatcagttgcttccgttcgtgctgcattaaatcatatccatccagagtgcattgaatattgcgtcttgtttggcaaaatgtcaaacaaacatgctgtgtaataatattggcttgtatgaacttatattcttttgtcagttttgtgctttttgagagtaagttgggactttagttgagtcttccttttatatgagattctgttatttgttatctgtacattccagttgaattagagaatgattatcttccatgcactttattattgtcttcgtttgtagatcaatgtagctggtttacaatattaatttcataggtttccatttctcattactgatcactgatgacacttatctgcagaatggaattggtcacgcagggctccagtttctcagtcatcctaatggcatgacccatggttctgatctgaagaagaatccatctcaaagtccccgttccatatttgggacaaagaatggacacttctgtgaggtatgatttttcttactacttcaatatcaatataatataaccattaggagttttacagctctttggtattgtaattgaagattattgactgaatgtcatatacacataataactcaagttaaaactgcaacctgtactgcacaatgatcccaatatcccattgctcggtcatgcaattacctgttttaatcatctttgtgaaaatgacatcaatcatctaattattaagttatagatagtgacaaactataatcatagcaacgtgttgtttatgatttcatattgtggaaatttttagtaatatttcaaaggcctgcccatgcaaacacatgcatattatgggttgataccacccaatttgcactttgaaacaaattatgctcattgttgtattgacccatgctatgtataacagtatagagatggcttagataaaacatttttcatgtaaacctacatggtgaaattagcttttccaatgtctatatgagcaaaagagttttaaaaagtgttctgcttctacactaaaagtgaaagagcagacaattaaagtgctaattttaaacctactttatgctattcagcctgaacgtttccagcttcccaacaatgaaatggagggtgcaacaaaatggaatcctttatgttcaaaaacatcagaggaagcgcagcatatctacagccacatgaaacatcttgaccaaaaggcaagtgctgtatctgttgtatctgctctcggagctgaactagagcaggcacaaacacgaattcaggaacttgagactgaacaccgctcctccaaaaagaagcttgagcattttctgaagaaagtcagtgaggaaagggcccaatggagaagcaaagagcatgagaaaatccgcgcatacattgatgacattaaagcagagttgaatcgagaaaggaaaaatcgccagaggattgaaattgtcaattcgaggttggttaatgagttggcagatgtcaaactctctgcaaagcgctacatgcaggattatgagaaggaaaggaaggccagagaattgatcgaggaagtgtgtgatgagcttgccaaggaaattggagaagacaaggctgaagttgaagcattgaagagggaatctatgaaactaagggaagaagtggaagaggagagcaagatgttacagatggcagaagtatggcgtgaagaacgagttcaaatgaagttgatagatgctaaagttgctcttgaagagaagtatgcacagatgaatagactcgttgcagatttggaaagctatatcaggtcaaaaagcacagagccgaacacaatggacatgaaagaggcacagtcacttcaacaggctgccgctgcaatgaacattctagacattaagggattttcatatgaaccccctaactctgatgacatttttgccatttttgaagatgcaaattttggtgaagtaaatgagagggagattgaaccatgtgtttctcacagtcctgctagtcatgcctcgaatattgacatggtgagtcctgaagccaatgcaataagtaaaggtggcattcagaggcgttctgatgtatttatggatgataatggggatatagaaggagatgaaagtggatgggagactgtgagccatgtcgaggatcaaggctcaagttattcaccagaagggagtagccgatctttgaacaggaatcaccgagagagtaacgtctcagggagaagtgtacttgaatgggaagaaactgcaggtgaggagacaccaataactgaaataagtgaagtgtgctctataccaactaagcaagcaaaaaaggtatcatccataacgaagctttggaggtcaacatactcaaacaatggggacaattacaagataatctctttggagggaatgaatgggagactttcaaatggaatgttatctaatggtgtcatcatgtctcccgatcatggatcaggtaaaggtgggctgagtccccaagaccttctataccagttgagtcccgagtcaggaagtccacatgcacatcaaggcatgaagggatgcattcctcgcactgcacagaagaatagtttgaaagccagacttatggaggccagaatggaaagccagaaggttcagttgcgccatgttcttaaacagaagatttagttttgggcataggcattgcacagattgccaacctgtaaaattgataaatgattgatgaaaagcagttcattttagattgtgagggtacaaatatgctgctttatggaaaaatctgctcacagtgatgaggggtcatgaatagatgcacattttctgcctcattctagtttttatttcagttcttcattatcattcatattaagctttaaaagcagataatcttctcattcccttgtgctaaattcctcaaaacctgggatatcttgggaaatagctcgctttgtcatctgtgattacaggccctgcttcattgggtagggtcttgagaaaattatgagaagcatgtagcatgtgttgtactttatcatgttcagaggacaaatgtgatgggaaaaaagatcgtcatataatatagatgatagcattatctactcaagattttgattttctatcattgtgtatgtcgcttaggatttgttgtagattgtattttaggaggtggcaaggatgatttgtggtaccgggacaaaaaaatataacttaatacttactctgggaccttttcctctttctgtttgtctcctttattgttcattttgatagttaatgttgtcaaagtataaaaaaaaaaaaaaaaaacaatgaaattgaaattagcatttttcctttgtttgctgattataattaagtcgaggtgataattaacgtaaggaatgttttaattttatgatgttacacgagaaggaaagctttctacctttagaagttttaattatgatgtgttcaattttagaggaaaataataaaaataatttttggatataaaagttttttgtgaatgttaatttgtgaataaatcagaatgattctttttcactttaataggtgcgaatgaattttttatataataattaattataaagttattaaattttatcatggtaattaaatacatgtattctcatgtttatcttccatagaagacaatgctacttgaatcttatgcaggataatttgaatttgaacgttcatttttttttacaattaaatttgtttaatcattggttttttaaaagaatatattttagaggaaaaaaagaagatttaattgcattcttaaagaatgtattgaattatgattttaaaagattatgtaaaaatgttataacttaagatatttaattagtttttttggtatcataattgtgtagtttggtcgtttaaattttaattgtgttaatttaatcacttaaattttcttcaaattataatcatatccttccattttgattttattaaatgtttattgaaattaattgctataacaaattaatatttaaatacattataccatctgaaaaacataaaaatgtggtgacctacaaagatagtttgactgttattgacttaattttttattatgtttgtggttatttttataattataataacaataaaaataatgccttttatcctgaataaattaataagctaaatattaaataaaatctgaagaaaaaaattccttttatcacgttcacaacatttttccagcaaaagcaataaaatcagaataaaaaagaactttattgtaaatgaaaaagaaacttacagaataaaaaaatgaaacttacagttgattcaacaaagtcagtgagttatgtaaatcttgattctgtcatataaaaaaagaagacagaaaaaaagagttgaagacggttcagtcgcgcacccgcgaatcagaaatttcaattccctccatttcccccccaaattcaaatcccccaaaccctcccttatatacattacatacacacatctcaattcaatttccatggcgaatttcgaagtgccctcattttccctaggtctcgacgatacgcccccccattccccaatccatccacctctttctcccgatcttcatgtctctgactccgactccgatcccgaatcccgacccgacccgccgcgccccctcctcaaacgcctccgtcgcgggcccccgccgccgtatctcgaccccgatgccgatgcctacgccgacgacgacatcgaggagttctcctctcaagaagatcccgatcaaggtcaggttagctaacacttcaaatatttcacctctctctcggctttttaattttaaataataatattaataatttccttattatttatctgttgtaatattattagggcatgcggttccatcggcatggaatcggaatcattctgtgtgtagcagctcgaaagtttcgttgaatggaagtggggttttgacccctcattcgtgtagcaactctttcagggataggaaaagaaaggtactttccaatgatgttccggcttctgccaggttagagacagggaagagtggcttgatgtttcccaagttaaccactagtcctctccgaaggtttcaattgattgattcggacaccgatgatgctgatgttggtgttggtgctggtgatgccaataaagttaaccctaacagtcatttggaacaagagaagaaaacatctgctgacgagaacaaaaatgaggatctgtggaagaatttttcgccggtgaagaatgtttctgttaataggtttcaattgctttcagattctgatgactcggatgttgatgtcggtggtgccaataaagttaacactaacagtcgtttgcaacaagataataaaccttcggttgatgtgaatggaaatgaggatctgtggaaggaatttttgccggtgaagaatgtttctgtttgtaaatttcagttgctttcagattctgatgattcagatgttgatgttgatattgctggtgccaataaagctaaccctaaccgccatttagaacaaaataagaaaacatcgcctgctgatgatctatggaaggattttttgccggtgaagaatgtttctgtcccgacgcctgccttcaatgagatatgtgaagagtactttcgttctgccaattgcaaggaagtgggtggtgattcgtctaaaagttttaatgagaggaatcctggggttagttctagctgccagagggatcaacaacgatgtgaatcaacagaccctgttcatcccgctcatacttattttttccatgaggatccgagaattcggcagttagtccgcagtcgcctgcggaattttaatccactaggtaccatcaacacagtgaatcagcaacctaatttctcacacattgattacatgtaagtcgtaacccatgttcatttgttgttttaatcttatggtaatgatttaaaaagaaagtgattgtcattttgtattacatattgttttggtgtattttgatttcaggggacaatttggtaatggaggagcttcaaacatgcagggagttcaaaatggttttattaatagctcaacaagggggaaaaacaaatcaagtaatttgaatgttgagggatcttttgatgcttctggaggctgggtggatcccaaaattgtttctccattcagccatggagaatcttctagaaagaaagcaacaaagaggaatggcactaaaaatagtgtctcaaaaagtaatagtaaagcaaacaaatcaaaccctgcgaaccaatcatgtgcttctgggggctgggtggaacccaggagctgcaccagtttgccaaaggatgcaggcaaaaggcgtgttcaagcaagtggtgaatctgctggtcattggtttacatcaccagaaggaagaaaagtatgagaaaaagtctttatttttttttaatgttattaagtattaactggttaaatttatttacttttctcatgttagatgctggtcataagaagttatgcgagctgttttgctgttgtttaaaactgaaatgcaaaaaacccatacagtatgttacttaagatttaaataagtgcaatgaaattcaaattatcacattacataatgcctcttttttttggaaatattgttctatgatttgatgcacacgatcccatcattccaatataactatgtaacactagatagtgatactcaatctcccattgtttttgtaaacattcttttgacattaagattaattgttatatagggaccaattcctacttgatgtttaatggcagggaccaattcctagtggttttgaaattataggaccagaaccataattgagaaaagcttttaagtctattttgtcatattgtataaatctatcagaacctgattctttatccccccttgcaggtttatgtcaacaaaagtggggaggagttgacaggccgcaatgcttatagacaatatcggaaggtacatatacttgcataccattctgatgttttgttgtccttttggttgtgatgtagcactgaatgcctttgatgtttacaggagagtggagcaggattcaagaaatcaagaaagaaaaaaggtaccaagacgacaaatgccaagaagagaaactgaacacttgatggcaagaaatttattatccgcctggtccacatcccataatttacttgtggatcttatgactagcaataccctataggttcaatgctgttaaattgccctaaacttccggtatcatgtgttggatgcggacaaggaagccagccatccagcatgcagcatcgcacgaggaaactgaattggggtcttgttgcttagtgaagatttgattctaaaaaatcctggcaagtagatattgtgagcttatgcaagtagttctgtacagtgcacaaggacctaatgtctttggccatcatgaaattgtaactttagataatgtttcactttttttattaggattcccaataatgcttcgattccatcttgattcaccacttggttctgtgttattatgatagcttgttgctatgtcaattatgcataatttacttctggtgtttgtagattaaagtaatggaacgatagaaatgatagcaaattttaagtaaatgaagacatcaagaagaccttttattccgtctatcttgagcggaggatagagatgcttcgcctgaattgtttgggctatttttgttgcttatgctgtttattggcttcatttgttgatgtttaatgcacatgtaccaaataaatactgaagtttacagacgatgtaaacttaaattaggacataatatttgtgagcggaaacttaaattaggacatacgtgagattagcatacgtgtacagattcaaaaattaggaattttcactagaaaaatagaaaaggaatttaattttccaaaatccttgtaaccttttaatttttttaataaaaaggataacaaaattgcttttgttaatagcgaataaagataaagccataaaggtggtcagtttcgcagaagcgtccaatcttcacgattttatttcatccaaaatgatagattgaatacaatttggaattaaattgaaaacttgttgacgagcataaaatctagcaacccttgacaaaaaataaactacttgattggttgtctacgtactaacttattggatggctttagtagaacgtggggccaaaaatgaaatatatatatatatatatatatatatatatatatatatatatatatatatatataaagcagattgaaccggtaattaccaatgatttcactgtatttgaagttatctctttcaactccccggacggggaaaagtgttaaaaaaaagttcacgtttatcagaagctattaaaaatttaggccttcagttcattcatcgtcttcattgatgattagaagtattctgcttgtcttcacccttttcttttggaagtggagaacccttggatttcaatatctgttggcatactctgaaaatccatcaaaatagaacattcattagtttttgagataaaatcaatgtatataatgacaatcgagttaaattggagcaaatgaacaatgctttgcttcagaaaggggtataattctgacccaaatgaatgatcatagtaccctacaattatgcatctctgaaaaggaaaacagaaagttaaaatcatacgagtttaaatcttctgtcttgctcttgatatcacttgacaataatactggatcaaagttcttagggtaaagatcttgctgttgcctcgtctctcttaaccactgctctgctttattgcactcattgatgatctgaaaaagaaagttgtcacttaaaaactgatactaagggaaacatcccacaattatacttattcactagtttattgtcgtacctgttctttatcttggggtggaagagaatctacagacattcgatactctacaatgcaacttaacaaatctcttgtagcttgtggtcttgcttctgtgtctttataccgaaactcaattggatctaccagctgcagaagatggagattataagcaagaagtatggcggatgaaacatggagattggagaaacaaaagtaacctgttttagatcttctagttttgcagaataaacatctacagtttcgtcatcaccatcatcataaagccaatcctcagtcgctttcaggctcctagatatgtccttcctctcatgttcgcttgaaaagcttagatatgtgctgaatagctattcatacatgcaaataaatttaaataccagtacagaatgaaaagtagagcatacacatgaatacagctttaataaaatcaacggtaagaaaaggcataaggattcagattttaattctatatcggtatatcctatgcagatgttattacaaagtataacagcagaccatccccagcttcacaaagttttacccttacatttacttgagtcatgacagaagtcattaaactatatacaacagctttttctcattttgatatattcaatactttcatatttacatggcaaaatttaaggctctagtttttgaagaaggaacacctcacagtaaagatatgaaaaagaagaaaaaaaggatcatacaatgaacaattatctattttagcagaagaaatatgtgaccgcttatacaatgtaattgaatcagagaagccagtcatgtctacatctcattaagatattgaatatgtaccttactcctcgtttcataaatataagactccaacgaattcttcttgtctttggtcagctcaattattctgtcctgatcggcgaactggagttctttttcttgagcttccaatatctcagccttggtcattctaccataaattttttcactcacaggtacatgaagccttctgttggctttacctttttttgtaccatcagcctgtaacaaggcatgatagtaacacttttattttcccaaaacaccaacatgaatcatatctgcaatcaaaacaatctccacaagataaaaatgtacatatacaacatcacagacattataaaaaacggttgcgacagactgacagtgaaagacatggtacagattcagtatcagaaataatcagataattaaaatttagccatataattgttcgtgttaaaaggacaatttgctagaaatctctaatatctgagatatcttccagtaaaaaaaggtgagcaggggagagagagagagaacaacatgggagtacttactgaatgatgtggagcttcacactttttattgatacaatcttctgggacattttcaactgtctcagaaacaggttcaacattcattgcttcagaatttgaatgataatcacctgttgtaactgaatcattcacatgatcctcgatcaactgaaagacaaaaatgtccatgtgcatagaaagatctctcagaaaactaataatgcgatatgaagagataaaattgaggtttcttactgtagctgattcaatactgataatgccatgcaaatttagttgaactcgaactttaattctcgccttacttccatgggatccaaggaaaggatcaatctgaatagaaatgacaaacaaatgcataagcatacaaaaacaaggtgtaggcataagcatacataacactttttaatcactggcacaaggaatggcagtatctcacaaccaattattataacttcattgtcctgtaatattgagatgtcttataatatagaatagacattagcaaatgttagccaattgtcattgaagatactaaatattaaatacagtcatttctctccatttgagaaacttagacagtagatatatggatggtgttagatccaccatatctgcttctcctaacattatgatttgttcaagcatgtgcacacctacagattctcatattgctatacctaacacttttacagcaatgacttcctttgagatcagaacaagcgatggtcagcaaggccatttaataatgaagtctttcgctccttcaagaaagggggaggtgtctattgcattgtcccaagattcaacaacaatagccttttacaaggtggggttggctacatggatcaaaaacaccataatgtcttatcataaataatgtctaaacaaaccatttaaatcttaatctttcttaatgatttaacttatagtttttcttcgtctcttactacctctaattattgaactatcttccatctaattcactctctttatttagagcttctacaagtcttcacatgtgtctaaaccacttaaggcacgattctaccatattttctacaacaaatggtgcctaactttctaaggaatcattcctaattctaccttgtgtgtctacttatccatcataacattcttgagttggcaatattgagctttattccttgttgagtttttaccactcaacattgaacttcaaacaacattgcaggtcttggatttgactcctctaaagtgagggaatgcattctaaagaataaagtgcatttataaccattgaataaaaaatccacggttgaaactatgataaaatacaagcacatgtataacaagtaatagctttatacataattgagtcctagacttacaattcaagagtaaaagctgcaattatgatgatgattactatatagtatatactatttttttttgtagaattaaacataccaaaacagtaaaatgaagaagatgaataagctcatagagactataccacatgcctttcatgaagcaccccaaagaagcaagaatagagagggtaataattaataaaaaattaataacaaagaatcacggacaagatgatctaaactccttcacatcatagtaaagttctaaagcaggcatactgtgaagcaactgattttcggagatgtcccaggtggtaattcatctggattagcatagaatgcttccagacggagcaaattactgcactgaaatgttagaattttaacacttggaatgggttggccttttgggaagagtacaccatccaatccttcacaaattggacttccatcacatgaaagtccaatggaaaaaggaatagaatcctggatctgaacaaacacaggaaattacattaattttatagagagtaatacatgctaatgcaaaattctataaaaaaaaaaacacatgattaatgatatctatgaagttagatatatttcaattaagatagacaaattaaatgcagaaaataaacctagcacctatgtaacaactttgttcatttagtaattattacatttctaacctaagaatctacaaacacaaaaatctactctcctatatatacatatcatatagataggataagaatcaatgtgtttttttcaatattcaaacctcatattctttgacatggaaaataggactgagcattgcacactggagagcacaaccacgtgctacacactcacttgcattcagcgtgcggctcagttctctcttaaatagagaagttaataaattagttatagctggaatccgtgaacctgaaccaactaactcaacagaattaatcttttctactgtcatgccggcatcagccaatgctttgtagcagggaatattaaatttctccaataatcctgatgccaaattctcaaattcttccctcttgataaagcccttaacatctttttcatccatcaaacactcaatgctcagatcagccactgcatttgcactcaaaaccttcttcaacttctcacatgctacacgcagcctcctacatgccctggcattagaatacacgtcaatgctgtactgttccttaaatcttgctgcaaaatgactaaacagaacctcatcaaagtctctccctcctaagctactgtcaaaagcatgtgaaagtatcttcatttgaccagcctgaaatgctgcaatagagacctgagtatcacaatgacctatgtcaacaaatgcaacataaataggagctgcattgggaaaatctgttttgcaaactccataactaagaccagttgcagtgcaatcatggatcaacctcaaaggctttaacccaataattgctgctgcgtcgagatatgtttgtctctgtaagttggtaaagtatgatggaaccccaataacgcagtcagaaactgcggtcccaaaatccttttcagctatagccttcaagtgagtaaagagcattgctactatttgaaccggggaaaacgtgcgagtctccttcaagtatttcaagcgaatcagaatgccaccatccgggccttccgaagtttcaacggggagcaattttaaatcattctgaacatcagggtccgcaaatctcctgcctattagtctcttcacttgagatattgtggacttagggtgcatcatagcagaaacagcaccagctgaccctataaaccgttgcttctctccaaagcacaccacaccaggggtttcacgtttggattcatcattcaacaaaacatcaatcacacgttgcttcactgcagcaatcacacagttctcatttccaatatcaatccccactccactcattttaatttactgtgtccttcccccaaactacaaacaactaattcaatccaattcaccctttctacgtcaccaacaacaacccaaaagtcaaaaacttcacacaaagctggcccacaaacataagcttcacatttcacagggcgctattactacaaaaaagaaaaagttggaaacatacacatcaaaatgaaaactttatttctgcatcatggaaagcaatagaaaacaatgatataatgtaacaataaatgctttgaatgaagtaaaaaagttctgaaactgaggaaatgctttgaaatgaaaaaagaaactccgagagagagtaaaatgagataagccaaaaggaatattgagagaaaatggaagaaacctgattttggtgaagagggcttcgagagaaagatgaatggtgaaatgtagaagcagttggaggctgcataattaagttgtaatggcagagagacaaaatcgccacaccgcactcgctcaagccatgataataccatccctatccctcgtacaaaacatttgtaatggaaaacacaagctatcgtcaacgaacaaatttgacaataatcagtttaactggggtaaatatataaaattaattatatttattgttgttatttttaaacacggtttcaatattaataatgatatttctcttatctttcttctcatgttcccatcacattttttcacttattatttatgacatttttcatcttttactgttgtcatcacattttttttttcaatggtcaaatttttttttttagtaatttgagtttatttatgttgtgtgtgttatgtaaaaattggtgataaaaataaacattggaatcccaattaagaaaatacctcaagtctctaaaaagagatctgataagaatttaaaattattcgcttataaaagaatttaacatgagattaatgaaaaaatttcctccacgttttggtctcccaaacattaatttccgattctagtcttagaaaatttgttgacactttttttaatcttacacctatctcttgtacactatcatgatttattcatgtttttattttttgtcatacattcatatcaatattttcatatctattacttcccacctttatttttgttcttttaaatttctaacattaattatcataaaatacaattaaatgtataacacgataaaactttgttgcaaacattttttcaattacaaacaactttcaattgtatcttgtgattgatatcttaatttctctttatgttgtaatattgataaaaaatacttttttttaaaaaaacttgtaataaaattatcacagggagactatttttataatactttaatcatttaaatattcaacttttaacaaataaatatttaataaataattatttttataaaattatctattagttccacattaaaattgatttttatttcaaatgatagaaattaaacatgcatgtgtctttataatttgtgggttgcatgaaagcatcaagactttgtctggcatgaacagccttattatcacaattaagatactcaatattatcacagttaagatactcaatgcaaatgatttgacattcacttcttaatttttttcaattatgataataaattataactgaatcaatttgttttttagaactcaaacttttgaaaatcaatccatccaaaaaaaattacaacaaaatttattgcttttcaaaactcaacgaccactcactaaagaccgttggattgttgggttgacacaactattacttcatttctatgtgtattttttgtgttgatcataaaattatatgaaataattttcatggaagtaatgattaatgttaatatgttattgtgagtgcatataaggtgattatttctatttataattgtttatttcatatacaaaatcatgattcgaacttgtatcacttgattgagggatacaatttattataacttgtataaataaatagttgttggcatgttcttcttccttttatatatgtaatgagggtcgataatcttattcctttgatacaaggttatttaatacaatcattttaaataaaacttttaattgtttataaactttttaaaaaaaatatttttttaatataattgtataattattttcaataaagatgtatacttataatagagggtaatttcattgttatcttttttaaaaacaaataaaagtttaattttcacactatctagcatttatcatatcattagtgtgaaaataagctatttgcttaaataaacatagttggtttaaaaaattgagagtttgttacttgtttaatcctaattaagttggacgaacacatttaagaggacagagactgtttttttattcttaacactcaagttcatgacttcaatcatgagtacttataatgaagtttcaatattagaattaaataattgaaattcagtactagtataatgaagtttcaatattataatgaagtttcaatattagagtttcctgagatttaactgaaagctccacatcctcaagcagttcgccaaggaaggggattgtttcagctatgaacactagatattcttctttctagttctccacaacatatttaacaattctgaggcccaatattttagctagcaatttttcactccgtgtctgcatcaaaacctgcaaaaaaccggataaagaaggcagaaatatattcagttgctaaggaatactagtatttgcggggaacaaacatatagcattcaagagctatacatattactgaatacccaaaactataacaacaaactaatgggctaaacacttcaacacataagtgaggcatggatgactacaaaggaccaaagctaacgtattatgaaatggggatgcaagagtacagaagcaagtttagatctttaaagatcattggccggtagggtaggtcaaaaccgcagggatacaaagcgtcaattgacattattactaaagtttgatcaaaatgacataaaagctacagtctatttacaattaaaccttataaagccagataaacatagcagaaaaggtcaactctaacatgactgaaaccctgttcagataaactattcaataagcacttacagaataaggaaaaaaaaaaagagcttaaaatgaattaagcttctctcataagttaaaatcaacttttatagaagttctgatttaggttctctaaaaacttgttttaacttgtgcacacgttaattttaacttaagaaactcaatccattttacctacttattttattctcttagaagttcttgttgagttttcccaaataggacatgattttactatgcttaggtgatgttgataagtagttgttagcaatgccaaaaatggaggtctagcaaaggaagttttggtaaggatttgctcgtttttctagtttgaatgactaatgttggaaagtccacatttgaacctgctggcattgctaggagcccatttgccccgtccaccttgttggcttgctgctgcatcacagctactgactgaatgtttacatgtaagaggagtggattcgttaaattaaaagttttggggggccatatctgtaatttacacttttattatggcctttagagagttaattacttctattgttagacatattcttaatctattgttaaaatgtcttggggcatccatgcacccaaactaatagggagaatagtagaaccagtcatattcataacagtgtttcccgaggacaacgatcatatgcatttcccctcaatgaaaaacaagatagtgaagccagtaagttaccagtatgtcagtatcaatttacttgcccaatcattaacgagtagtagaaaagaatagaaatcataaaattcacctcatgattcaaaggtttccacaaaaggtcagatccaccagtcactgccatttgaccgatgcacacaaccagtaggtcatcaacttccttcacacttagtatattcatgctgtcatccaacagagctggtggatctacaacaagttgtgaaacaagaggtctcaacaacatctgcagcaagcatgatataacagtcagtgagggaatatagcaagcaactatattactgaaggaagctgaaagatttaggaatattttattcctcaatggaatgagaaaacatgcaaagtatttttaaatggaatggaaaaattgccaattgatgcataacctttaaaaattccaataggatttctgtattcaaagggcttctgcatacactagccaaactgataatcacatgtcagaactgacagtgagacaaacttttgattttgctaacagatgccaaggttcaagtgatgtaggtatgtatataatatattagtttcgttatgcgccatttttagctatttttattttccatttcagaattcagttacttaatttcctggtctaatgtcatgaacagaaattgtgaaaaatcttgaacgcttggataaggagaaaaacatactgccaagtccagaaattgatgcattcatgaaggttgtctcatcttataaataatatctgaaaaatcatgcatatatgcaagttcagggaagtcctctaatttgtgttttttttaaactgattttactcaacaggcaacacttgttggtggcaaaaaccacaatgtcgagacagattatgttttgaaagtgcttggtcttgatgtatgttcagatatggttgtaggcaatgatatgctaaggggggtctctggtggccaaaaaaggagagttacaacaggtgatctctctcccctttctaggaatttgttacaattttctttgaaatttggctcttgtagtgatatgtgctcaagttaatctaactggattacctctttagtgtatcatacaaagaaagagggtccaaattcagtctctctatttttttccttctgtttttttaagatgaagttaatgtgaaatatagctttgataggatttaaggagatttcatttagaattttgtttttgactcctaagattggagagttacgacaggtgatctctctcccctttctaggaatttgttacaattttctttgaaatttggctcttgtagtgatatgtgcttatgttaatctaactgaattacctctttagtgtatcatacaaagaaagagggtccaaattcagtccctctatttttttttcttctgtttttaagatgaagttaattatttccacttgtaatatgaaatatagctttgaacaaaggcactaattgaagttaaaaattgtagcaagcaatgacatacttttgcatttcatatcgtaaatatcaattatgaatggaatttaataaatcaccaattttgttcccaaactactatcctctccttaattgtccctaaagtaataaaattgttcaagcaatccttgaagtataggatattcatcagtttaattagttcttaagttgatgcatttcaataaagtttaaggcttaagttgaaaagtctttcaatatttaagagattacttagtttttcttattttatcaaccattaaggagagagtagtatttcaaggatcaaattgatagtttactcaataagtaatgtaaaataacagaagaatattatagtttgacaacaccgctgatattattcaagatggtcaaggaatgtctttaaggtcgacctattggtgagcttttaaaaattaactaatgaagaagttatttttgtttataaaaaaatcgtctcatttttttcttttagaaatacttctagagaagttgatccaaacatgtcaaaaacatataaagagcaatggcgggagatccagggctatattaattatctataagaaaacgtaatgaattattgagctagagtacggacaatattattgaactaatgttattacacataacccataatcaatatttttactaaaaattaatttgattaattagtaagttagtatgagagtgagtaatatgtatgaacttcaaagacatctcgcatgtaattaatcaaagttggcagagatcttgaacctatatgaacatcagctccaattgtcaagtttcagtatctcacttcgatacttggtacatccaatccaacccttttgcagtcaaccacacaaataatttaaatgcaaaatcatatataaaccctaatgcatgtaatcgatatgagaattgttattttttttgtaaaaatatttaactctcttagcattccttgatggcagagaggagcttgtaattgtcttgttcattggttgccaaagcatccttgacgaggcgttcaagcggcttagcttcctcacatcaatctgctccaaaaccttggccttcttcttccctgagtcacctctgttgctcatatccaaagacggcgccatgttggcacgcttctgcgtcggcaacctcagcaatgcagccatttgaagctcctcctcatcttcttccatccattcggcattggaagcccttgcaaacgactccctttcggacgccattctttcttctctttctccattgtgggttcattaggtatttaatatgtttgttttccattccgtattttgttcattcggccctattgtatgatggtttgttttggtccctttctagaaggcaattttctttttaagtatactcatttagcataaatcaaacaaagggaaatcttccaatgcagattcaatgcacttcattaattttaattgttataaattattttaaaattcaaagaatcagacctagaagtattcaatataaatataaatactatacatgcttgtatattggagtgtggaagtagatactgggtaacttttattttattttattttttttttgatttgggggaacttttatattatatttgaactcagagaaatactttttatatatataccaatataaagaccaagaactaaaaatttaaaagatgtataattatgatagggtaatttcattgttatcttttttaaaattttaactaacatattttttttttaacaaacatgttagtatagttgtttgtagtcatttattgtaattttgtaacaaaaagcttttaaattatcatataaaaacaaataaaaatttaattttcacactatctagcatttattatatcattagtgtgaaaataaactatttgcttaaataaacatagttggtttaaaaaattgagagtttgttacttgtcatataaatatgcaaagttgattatattatagtagttattattttgttgttaatttaaaaacaaactcaatattaataatgatactaagtagatattttgcttatattataaacaatatatcaaaataaagttaattgaagaaatatatactatattttaaattatataaaattctatttacttaaatttttagttacaatactttttagaccttaatagaacagttcaaaacacctaattctaatgtttttttttattcttagcactcaagttcatgacttcaatcatgagtacttataatgaagtttcaatattagaattaaataattgaaattcagtactagtaaaaaagttattgaacaaagtaagtaaaaataaaaattgattggagtaaaataattagtgaagggtttgaataatgttcaaatcttgtactgttatggctaatttaaattggttaattaataatagcaaagaataatactatggacattttaaaaaaagaataacatacgtaaagtatgctagctaaacttatattgcaagtattttatttatttttttatttacgaaaattaaaaaatatgtataaaagatttataataacttatgtatcattttcaatcaaaactacgttcttatatatgtatcactcatgcaacttatatatgtatcactcatgcaaccagagtgtttacataaaaaaaaaactctctaatgtcttacctaaccctactcatacaaaattggtcatttataacctcacttggatcggatgttaatctactcattaatatccatttatgccaagacatcttatgcaatgtgtgttttttcacatttgaatacactttgcatgagttgagagttgagaccaatattattcattttttttgctaggcaaagatactccattaatagaaagactggaatagagcacaaggtgtacccacatcaaactcgaaaaaacaacatacatagataataacggaacatactcgaagagtatcacaagatcaatacatatattcctatttcacactacctgctactctatatatcacttttattcagagttaaaaactaaaatttaagaattaaaaatttagttaacctctactttatatatcactttctagtttattcaagactgatcgacaatgttttgtttttttacctcatttatttttttaatgaatagctttgtactgaaaaagaaataaaacaaactccgaaattaatcctaaatttggtaaacgctgttgtcggtgttgtaatttgtaacccagttaaatccattttagagataaagtttatgtgatctaatattatgattttgttattttatcattggatccattttaaatattttctaattcagtacaattcaaattacttatagagaaagcccatcaatatgctgattggttttggctaaacatgaaatttcttcttcatctctttgtcaagcatgagagttgtgtccgcttcagctacctttgttagatagttgttgattcttcttgttgtcttttatttcatccactaataattattatcaaaattatatgaataacacaattaatttatagtttaattattaaattaaaatttattattataaaatttattatgtaaaattatatataatattaaaaatttaatgttatatatcaatattaactatttttaatataattagtttattagtttaattggagtgttgtgttcaacctcacaagttctagacatgtatgaaacataaggcgaatcatatccataatcacaatagtatggagggaaaaactttatacacccagaaaaagactaatacaccattccagaacagtgcatttccaaaaataccctcacttttattacacttcatacatacggattcgtgaatctgtaagattcttacggatttgcgaatccataattttttttgagttatacggattggacaatccgtatgggccatacggaatctgcggggtcccaaatgaattggcttattcaaaaaaaaccccgttctttggaagatctatctcgtgtctagtactgcatggttccaccctgcaagaactctgaatcattctcttgaagctcatgctcttcatcataaatgatccgcttgtcccaaaatgacctggcccaacagggaaatcccaattcattgggcctttcaatacaatcaaatagaaagccccaagggcgccatattctaggagcccaaacaatgtgattgaaaaaatcctcctctatctgttgtgggtcgaggactccctccccttcttcaaactccgattcatatttttcatagagaaatctctgatcaacgatagaataagatccattttgaatcatatttaagggattccttggttcggaccgaagaaacaatgtcactcgatccttatcaaactcactgcaatctttttctgtacgtgaggatcccaccagagcgccttctacttctaataggccatgaactagatcagaattattctcaacgagtccataagatgtgatcccatttttttcatcaggtctgggtagagaccaaaggtcttgagcgaccgatctggcagaacaactcaaaaggtaaagaagtatcgttaatttattcatactcgttccaagttcgaagaaccatttgtatccgtatggcccatacggattgtccaatccgtaagtaagtttttttttaagttaaaatatatttttccaaataatttaaaacaatggcgcatgtaggtctcttattaacgtaacgctccaaccaactgagctaataggccaattatgctaaaaaccaattaatgttatacatgtaacactaaattttttaatgtatatttaatacacgtataagtttacataataaattttgtaacaattaattttgatttaataattaaagtattttttacatataaaaatcatagttttaaataaaaatcataattttaataaaaatttgcaggactaataaaaattatatttgtatttacaggttaaattaaaaattatatctgtatttatagtttattaaacttgcaaatttttattaaacttatgatttttatttaaatctatgatttttatatgtaaaaaatactttaattattatatcaaaattaattgttacaaaatttattatgtaaacttatacgtgtattaaatatatattaaaaaatttaatgttatatgtatcaacattaattagcttttagtataattgatctattagctcatttggttgaagcgtcgtgttaataacctgaaggttaaaggttcgaaacttacatgtgtcattatttggaaaaatattttttaacttaaaaaaaaaaacttacttacgtaaggttcatacggattcacgaatccgtaagaatcttatgtattagtcttttgctggtttataaagtttttccctagtatggaggaaaataaaaatgtgtacaaaaataatggcaatggattaatcggaccagcccaatcattcatcactcggcccattacgtagctcatcgtcgttcacaaaaatgaagcttaaccgccaacaattcctgcactgcaaactctttctgccgcaacaacacgcaacacacaaaccataaacctagccccaactttccttttcatcttcaccttcaccttcgttttcaagctacagcaatgagaaggccgaaatcgaaggagtttcgcaagcaacagcgagtttcagaggaggaagagataagcctcttgaattcatggatccagtttcagccaccggactccggttcgaacccaatgtcgctgccgcgtctccccaaaaactcccccgttggccgcctcgaagataacacctactcgcgctacgccggcgcgtcacgctttgatcaatttccactctcgaagaaaaccaaggacgccctaagagagtccaagttcgtggccatgaccgacatccagagagcgtctcttccccacgcgctctgtggccgcgacatcctcggcgccgccaaaactggctccggtaaaaccctcgctttcattatccctgtaagtgcttcatttctcagctccattctcttcggattagggtcccctgtatttctttttatttaactaatacaaatattatgataataatataatcacaagattagctcaaagtgagaaaatatatagtaaatagaatatgatatattgaattgtgatgtttatgcttgttattatttgtttatcgtggtttctgaatgcaaatattatgataataatataatcataacattttactaataagtgtggaaaatcaacatcgaaagttcaaagccatgagaagctgatacgtgtttgggcaaggtcattgatttaatatgtagtgggtgaatagatggtatattgaattgtagtatttgtgcttattgttatttgtttatggtgaattttgaatgataggtgttggaaaagttgtatagagagagatggggacctgaagatggtgttggcagcatcatcatatcgcctacaagagaattggctggtcagttatttgatgtgttgaaggttgttggcaaacaccataattttagtgctggccttctcattggtggtcgaaaggacgttgacatggagaaagaacgtgtaaatgagctcaacatattgatttgcacgcccggtagactgctgcaacacatggatgaaactcccaattttgattgttcacagacgcaggttaatataactttttttcttatatgtgatagattaacctcaatctgactctgaaattagagttacaattaagttgtttgttttatatcactatctgtttcctcgtgtctgtttttaattgtacttgggtatgtcaagattttctatccttaacaaccttcagaaaaatttgcttccatgcctaggtgatttagcaacagtggttgaagcagagtataggtgccgtttaatttttatatgctttaggcccttgtaaagcataaattttttattttgtcttccaaagtacgtgtttatttgggtcaaaccagaaaacagatatgtatcattagatttgatcaatatagctgatggttgggtggacttcccggatataggttttggtactagatgaggctgatcggattctagacagtgggttcaagaaggaactaaatgcaataatttcccaactaccaaagcgtagacaaaccttgcttttctctgcaactcaaacaaagtcaattcaagatcttgcaagactaagtttgaaggatccagagtatctgagtgtgcacgaagaatctgtgacttccactcctactctgttgaagcaaattgtgatgattgttcccctggaaaataagttagatatgttgtggagtttcataaagacacatctacagtcgaaaacacttgtctttctttcaagctgtaagcaggtaactccaactccccttttctgtcctgtttcaagaaattctttttcttgttgaagggaattgtatgttataggtttctattacaattttactgtcatgccacttgaaaagttgcaccctttgatgcttagccaatgcatggctattggctagtcatcattttcaagattttttgtgcaattggagggaatgtagtttgattttatgattgaaacttgaaagttgtctcattagtttcatattcaatggccaagtaaataattgttttgttttatttgtagctacatgatgaagttcacatgcgtagaacttctgttatggttttcagttgcgctggttatggttattgtaatgagaaaatttttaaaggatttttaggatgaatttttccataattctttcatgtaaacagggaaaatgtttaagatgtggtttttggtgcaaattccctcttttgagcttgactatcttccataatgttcacatccctgcttaataggtaaaatttgtctttgaagcatttaagaaactgcaccctggcataccattgaagtgccttcacgggaggatgaaacaggaaagaagaatggcaatatattctgagttttgtgagaagcgctctgttctcttctcaactgatgtggccgcaagaggccttgattttaataaggcagttgactgggttgttcaggtgagtctcatcctgcttttggtttcctgtcttggagcaagttttagggctttgtggtggggtgttggaagcaaaaagcttgtttttatgttcagtctctcacttctctcttgcatttgtaggtggattgtcctgaaaatgtagcttcttacatacatagagttggtcgtactgctcgatataaatctgatggaaagtcagttttatttctgttgccttcagaaattcaaatgctggaaaagttaaaagcagcaaaggttccagtgcattttaataaggtacattttccctgcaaattaatagtatgcatgcaattccaattttcatttgaacatcaaggtgtcacttttaaatctgcttcacttcagtcttatgtttgtctgacatttgctttccatgtttttgcaattgttgattattcagccaaggcaagaactactgcaaccagtttctagtttgttggcatctttactggccaaatacccagacatgcagcatcgggctcagagggcattcatcacatatttgagatccatccatatccaaaaggataaagacatatttgatgttatgaaactacctattgacgagtattcagcatcattaggtttaccaatgacccccaaaatccgttttctaaaccagaaaattaaatctaaagatgtgacaactaaatcaactttagttgagccagaggattcagacaaggaaactatctttgaggtttccaggaagaagctagacacagttgctttcaaggatgaggaaaccgaaaatgatattcttcagttagcggatactgcaaatgaaggtgaaattaagtcatctgaaattgaagaaataatgtacgttcccatatacatttttacagtggtacagattaaaaaattaggctgctttctgataatgctgcattagtttttttatatatgattatggcaaggggctacactagtcttctggtttcaaaattgctgagacaaattgatatttgaatataacaccttatgatgtggctaatagaaaaaaaattcaaacttagtgttgggtataaagttggatctttcatatttcttggcgggagccattcatctggagctttgaatttcttcctccattattattcttaccaatttagttctttcctatgcagaccagcaactcgtgtattgaagaaaaagaaactcaagattaatgtacacaggccacttgggactagggttgtatttgatgatgacggccacacacttcctccactagccaggatagctgacacacaaagtggcaaagaaatgctgctcgatccaggtattccatacttttcaactgcaaactgaagctgaaggtgaaattgttgcttgtacatgtgtatacgtgtcatttcgttccttgttttcatagttttgtgaaaataataaaaaatgttttaaaatgttaaattatagctacacacttgtttaccaattagaaaacccttttgtattttctgcaatcatcattgaatttgagaacctggctagatctcattctcatcagatcactatataccattttggtcttcagagcattgaagtagctaacttacatgtatgttcttacttcataagcatggactatttgtacattttgccacatcatctttatgtcttgatgcagaacaaaaagctgaatactatagaaggatgcgagatgatttgaagaaggctgacaaggaagacaagcttatagagcgtcagcggcttagagaaaaaagaatcaagcagaagttgaaatggaaggctgggaatgcggaagaggacgaccaagatgatatatctgggtcagaagtagatgagactgtagatagacggcataaaaagagtaaaatatactttgatagtgacagtgatgagggtgaaagaaatgaagtttcagggaatgcaggtataactaccggtgcggttacgttggaggagcaagaagctctggctttgaaattgttaaattccatgcactcataggatatgcgtaattcagctggacattttgtgacagcaaaaactggtgaaaagagagcaattcctgaaacattttaggagttctgttaacaaaaaattttgatctcccaatttttttctgtcatctctttcaagaaacgtatacatagaatcaatttactgcttttatttattttaactaaaaaaaatgggactaaaggacatccttgtgtgtaccaaacacgatattaaatattattaggagatattcataatagttgtacttcaaaatctgaatcgtttacaggaaaaaaactagcaccaaaatggtgtctttgccccctgttagttagagaccccaatgaagtctatagaaatgtcagatcaaatgttttgtggaaatgggccgagtttatggtctcgtacagtcgtacttattccgttgcattgtataggcgtggaagaaacttgagtgttctcccgttgcttagactgcgttttggaattaagacaacaataaaaggatatggacataatttcaattatttatgagaaacaagaactatcaacgggagcttttttggtttgaaaaaaaaaaacttttggatttctgtttattacaactattataaataagaacttaattattacaactattaaattaaattaagggtttagattaaatacttaattacaaatcttgtcattgataatattttttacaaattttgtgtattttcttttaaatggagatgatagtaatgacatgactggtttgttgataagaaaatggagaagaaaacaaaaactccatccatccatctggtccagtcaacccatgttcatgtattttatttcagcttgacattgaagtggggcgcagcaaggaaattaagcaaaaccgcgtagggcatcgtgttaatattttaaatttatgaaagagagaaagagaagtagggaggcattggccattaggaggagtcaacgagacaagcaagccaccttctgctacttctcatccatcatgtcgaatgaactcaaaaactacgatgtttttctcagttttcatggcgaagattcccgttacaccttcactggtactctctataatgctttgcgcagcaagagaatcaagacctttttcacagaacatgaatatgatcgtaaactacacactcatgacagccaaattccacactctactcttgaagcaatcaaggaatcaaggatttcgatggttgttttctcggaaaactatgcatcctcctcaagatgtcttgatgaacttgtggccatccttgagtgtaacaggacgataaaccaactggtgtggcccatcttttacggagtgtatccgtggcaagtaaggcaccagggcggtaactatggagcatctatgtctaaattagaagaaatatttagagattccaatgagagggtgaagcaatggagagcagctttatttgaagtcaccaacttgaatggatggtgttaccaaactgggtatgcttaattttagttgattaagttccattattaatctctacaactgctagcatagcatggcaccacttctttattacttattgtatctgtaatctgctgaacagtatgtctgatcttctaattatcgttttagaaagtcactttgttttgtttaaccgagagaaatacatgtgtgctgtaaattaaaggttctgtttccagtttcagtgtagcagtagcaatctgttctgtgcatacatatagattagtcaagcttaagtcaacttataattctgattaatagaaacaatatggttgtccatgctcgaatacccctggtgaattaaaaagacttgtgcttttataggaggtaccagtatgaatatgaattcatcgaaaggatcgtggaatcagccgtgcaagccttgcccggatatgatgtttttctgagttttaccggagaggatacccgctatactttcacaggttttctctataatgcctttcgccgagagggattcaaaatcttcatggacgatgaggaattggagagtgggaaccaaatatcacagaagcttatgggagcaattgaaagttcaaggatttcaattgttgtgctttctgaaaactatgcatattccacgtggtgtcttgatgaacttgccaagatcattgagtgtatgaagaccaacaatcaaatggtttggccaatattttacaatgtgcaaaagtcggatgtatgcaatcaaacaaaaagttatggtgaagccatgactgaacatgaaaaaagatttggaaaggactctgagaaggtgcagaaatggagttctgctttgtctgaaatcaacaatttggaaggagaccatgtcaaagaaaatgagtacgtaatgcttttaattagttacttaatatatgcttccctcttaagtgatattgaccatctatgaaatgctaaacatggcatagttcttgtccgagacatggggtattgtgtgttgttttgtttggagcagtttttgtattttgtacggcaatctgttagtgagaagattaattagtcgagcttaatattgttgttttattgacataaagtctgattaggagaaataaagtgaacacagcggatgaatgtcttaaaagaccttgcacttttgtaggtaccaacatgaatttatcgaaaggattgtacaaaaggtcattaaacttgaaggtagcaagcatatagcaaatcctttccttttatccaatgacagctacgaggaagaatgagtgaaagtcggtcaagtatatgctgtggagctgtgtgactaattgattgtaacatcaataactgcccttgaattcagttgtgcctatcaatgttgtttttacatccagttcaattcctaaggtttattgtattccttctaaatcttgttcaattctcgaggtctgttgtgttttttctacatcttgtttcaatgttttgtgttgattagataaaaaaaacaagtggtactattttgttttgtcatattggcattaggtaaggcaccgtgaaacaaaatttaaacacatcgccttctactcacaaaaataaaaacagagtatacaaaatctatggtaaggttaaataagttttcatcattcatctatttcagaattccatttttaattctctcaatcttctttatccaattttagtctctattttttgaagtaagtttagtctcccacgttaaataaaaactatcaaatacttatatgtccaacaaaattacatgtcacaacacacatgatgtaatcatgtgacaccgatgtgggtgatactaacatgtttagtcacatggtatcatgttttctaagtctttagaaatttttgaaatttaaattttagttcctaaaaaattatcatctttcaattttagtcaatataaatttgttttatttaatttaagtcctttaaaaaaaatttagtttttaatccttaattaatttttttaatcttagtatagttatgctttagtgatttgttggtcatgagttcgaatatgtaaaaagtttatttacatatgcaagagtaaggttgtgtacaatatctttttccttatttttgtataacaaggagcctatgaacaatgtgatacataatttttttttctagtttaggtatttctagaatatttaatctcttcattattcaccttggtatcacaaatatcatcacaagtatgttcaaaccattatttggttaggtcctacattttgtcccaattttggattggatttttcttcctacaccagctagtgttcccatacacccaacaataaaatgaaaaactgaaaatacccttccgtaaggttcatacatattggccaatccgtatcctttgttgtcgtcaagctcagtgccctcccagcctttggccaactcaccgacatcgtcggggtccccacctctaaccgcatggaagagaaggcccactccctcggcatccccctctctatcctcgaccacaatccccacctcgatctcgccatcgacagcatcgacgaggtcgatgaggcgatctgtaatccataagattttacgaatttgcaatccataagattcttacggatttttcaatttgtatgaaccttacggattgtcaatccgtatgaatcttatggaagaatattttttatttttcgttgtctttggtgggtgtatgaagaaatttgtctagtgcatgaaaaaaaatgcttatggatttctgttattggaggttcattttgagctatgactcttgcactttatttttattttgaatagaatatacaattaataatttctatatgttcaaagtaattggatccacatttagacaattatattttttttctctctatttggcgaaaatattgtgtaagtttgtaattaattagaatttaggttgaaactaattattttatttgatgtggttacttattattatatattttaatgatttcatcgtattattaattgcttgtgatacaaagttaattaatagttgtgatgtaaagttacttatatttttgcatgcaattaactatatctaatagtaaataatttttagtcacagtaaaatcaactatatttatacatacaatataatttctgcattctgttataattgtatttttaggttgttatatataaatagttgaaaaagaatgataattttatatcatcattaatttatttataaattttattgtctattattaatctcataagagatataaataaaaaaagataattaatattaccttaaaataataataaaataattattttgatatttttttcttgtgacaattataattagattaaggaaataatattttttttcaagtggtgatgaaatgcacaaatttgagtgggacaactataattttcgaatagaaaatggagaagaaaacaaggactccatccatgtattttatttccaggaagcagcaaggaaattaagcaaaagcgcgtaaatgatagtgtcagcacatcatataatatcttatgttatctgcttaatagtttcattgcgatggcggatgaagggggaattgcgaagtggcgctacgatgtatttctgtgttttagaggggaagacacgcgccacaccttcacaggtaatctctatgctgctttgcggaaggcgagattgaggacattcttcgatgttgggttgaagggtggtgaccaaatctttgaagctattgttcaagcattggaagcatccaggatttcaatcgttgttctctccaaaagcttcgcgtcttcctcgtggtgccttgaagaacttgtcaagatccttgagttaagggcaacaaagaagcaactagttattccaatcttttaccacgtggatccctcccatgtaaggaaacagactggtagtttcgaaaaggacctgattggacatgaaaggcgcttgggaaaggactccgagaaaatacacaagtggaagtcagctttgtatgaagttgccaccttggccggatggtgtttcggagacggaagctgcaggtatggcgttttttcttcttcttaatttagctagtaccgcttcttaattttaaaaaaagaaaatgaaaataataattttttgtaggcattcaatactgccttacactttgagagaaaaaagaaacacagaacaacgtgacattaataagagagataatgaaaaatataggtgtaaatatgtttttaatagtttagtgttttttttttaatttttgtaatttttgttatttttagtctttataaattatatatatatatatatatattttacttttagttttaaaattactttaaatagtactctagatagtaaaaaaaaaaaagtcctataagaaccaaaataaaaataaacattgtttgtaaggattaaaacaaaaaataattttataaaaacaaaaaaataaatattaaattataagaattaaaaagatatttaagttaaaaataaaatgtttcgatccaatgaatttttagcctaggatggtgtttatgtatcattgttgaaattaaaatttcatatactaagttaagtaactcatgccgattattattgctgaagtcatgtaaacttgcattttaatcctcaaagaccaaaaccacttgtgatatttgcacgaagcttttttccttgatttataccttattgaatattctaacttctgagttgtcaaatgactcgttaacatgggcttgagccagtttatgtctagaattgcaaggctttggccaatattcttaaagtgacaatctaacgtaactagttaattctcctttcattcttaaaagaaaaacaaaatagaaaccaacaataattatactctttgataaggaatttgttttatgaattatcacactagaatttattattggtaagaaacaatctaagcttttagctaatttatcaagttaattttactttgttttgacttacgagttttaaggtttgaaatctttggggagattaattattcaaactcaattttattatattaaaaaaaattcttttaagcactctttattaaaattataaaatttatagatctcactttttacttaataattttcattcataatttttaattaattgtaagaaatgtgcaagtgtgtgagagagtttcttgcttgaacccgtcttaaagtaatcaataatagataaagaaaaacgtaaccagtgcatgaatgaattaaaaggtcatgtacttttttgtaggtaccaatatgaatatgaattcatcgaaaacattgtgcgagaagccatcgccattgtaccccgctatagcatttttctgagttttagtggaaacgatacccgctcctttacaggttttctgaacaatgcattgtgccggagtaggtaccaaaccttcatgaatgatggggaccaaatttcacaatctactaatggagttattgaagaatcaaggctttcgatcattgtattttctgaaaactatgcacgttcctcgtcctgtcttgatgtgcttttgaccatccttcagtgtatggagacgaaaaaccaactgatttgtcccatcttttacaaagtgttaccgtcggatttaaggcatcaaagaaatagctatggtgaagccatgactgagcatgaaaatatgttgggtaaggactctgagagggtgaagaaatggaggtcagctttgtttgatgtcgccaacttgaaaggattttacttgaaaaccgggtacaacacatattattcttttactttttgcttattttcatgattcatgtctattatactagtaatagttgatgataataatcacttaatatgtgcatcgttcttgaaattctatgaaccgtttaatttgaaatccgttcatttaaatttgactttgttaacaaggaataacgttgtgagagacattggggtacggagttaaggctttgtttagagtttgcaattctgtttttgttgttgtgtggtaattacttttgtgcggatttactttgataattttagaaagaaaatgaaaattgtgtatgaatgaactaaaaggccttgtatttttgtaggtacgaatatgaatttattgacaaaatcgtggaaatggccagtaaaatttaaaatggcttaaatcgatcaagccctcgctcaagtgtcaactagaaggcagaactgatcaattcaacagattacagatggttctatgagcagtcattagctcacaaattgatagtaatagtcgtaatgcttacaatcagcactgaggaattgatttggaagtctgaattttacttagaacattagcaatttctagaaaggtgaatatatatgtcctgagggccatggccagaggcctgtcatcttgaaattgtgacacacactctcgtttaagtcatatttactttgatttcccacatgtcatgcatatacaaataattgtatgagttagattaaagaagctttagcattaaacagattgaagacaattacccagttaagatgctgaatgatgtttttgttgagaatcaaccgacatagttattcgtgatgtatataatcgaatttcgtaagacacaccaaacatatccttgcatgataacttttgattttggggtgtatcccgccgggaagatattcaagattgtgcagtgtaacaaatacccttaaaaaatgattaacgcattatgattttagttagttaatagtaaaacgattgctgcaagtttaaaaagatttgaaatagtttatagtattttgaccgtgaaattttgtgcttgttttagtcgacacaatcccatagatatttgagaaaaaggataaacattttctctgaaagtcttgtatcttcctcaataggtactgtaccataggttaatgttaaatttttaacatgagaacaaactaaaagtatgtaataaagagtaaagtgcaaattgatcatagaagaactttaaaataaaagagtattgacgaaaataaagtgcgcaaaaaaaaagatacaaaaaattaaaggagtaaaaagtttggagaagaaattgagattgaaaaaagatgaagatttaaagggaagtataacaaatgtaaaagaaaacgataaaatgaataagataaagtgctgaaattaaaatgtttgagagtattgtaataattcattgatccacaagtgtcacgatgagacaagaggatatgtgagtgtttacaagtttcaactcttattacaaatttttaaatcttcctcatcgataactttaatattcaatgtcaatcattaatgtcctttgtctttggtattcgtttttaatatattcttcaagaggtatttgtagatttttgttcctctaatggttaaactcaaatgctttatgaaattattgcttaaaaacatgttattttcccgtgtcaggtgacctctaaaaaagatcaagctcaatactgggctgattcttcaaagccatataaatttatttcagtgccggagattgcataagcctttaaaaattccagatttggaaagtcggtagaatccatgtgtactgctccctttgataaattaaagagtcatccttcagctttgcccagaactagatttgttgtgccaaaatgggagctctttaaggcgtgtttctcgcgcgagagaccttgatcaacaggcataagtttctctatatttttaggacctgccaggtatgtatatatactcaagtaaataaggatgcacttgtttctatatatagttttcaattcttaagtttttttacaagtagaattcatgataagttagcctaatgtttgtgatttcttggtaccacttacagaatagttgtcagtaaaatttgttggaattgtcacatgcacaatgtttgtgcaaacaaaatttcatggtaaggatgaggaatatggcaatctctatcaatctgcactaattttcggactcatacacatgatgtttaatggtcattctgaattgtcactcatgatagcgtgtcttttacaaacagagaggcaatttattttatcctggacaggcatgctctttggccacttgtattcttggtgtaccttattcccttgttgaagctatagtatacaacacaagaccatataacagcttcaacaagggaataaggtacaccaagaatccaagtggccaaagaccatgcccgcccaggatcaaataaattacctttttgtttgtaaaagacatgctatcatgagtgacaattcaaaatggccattaaacatcatgtgtatgaatctgaaaaatagtgcagattgatagatattaccatattcctcatccttaccatgaaattttgtttgcacaaacattgtgcatgtgacaattccaacaaatattctgtaagtggtaccaagaaatcaccaacattaggctaacttatcatggcaaaaaaattaaaaaatagcagtttaaataaaaaattacaagaatacgacagtttcaaaagtattttgaaatctattgtagtcaatcacgtcctggctggacgtgttcaaacacgccccagccaggcgtgattcaggtccattcacgcccttcccagacgtgtttggtcacgtctccaccagttgggataggtgaggcagtcacgccccacccaagcgtgatcttgtgtcattcggcgagaaaatggtgttcttcttgggaaaacccggggtggcgctggaagacaagtttcttatggggaaagcttttcaaagtagaaagtgtcgagtaggacctcgacgatgatgctagcagcagcacacacgtgtgtgttaaggacggccagagatgccaccgtgctcgccacgaacggacctccaccgttgaacccactccaacccatccaaagcaggcctgcgcctgcaagcaccataatcatgttgtttgatggaaatatttctgtccttttcagatcgtggacccacctattcaaatcaaacaccatcacaatgcaaatgtcagcattttattataaagaaaattaacggcttcaaattattcacacaacaatgtttgtaatcctttctcttgaatattcattgtatatttgtacatataaataaaattaagagtgaaattaaattttatttcaaaagttgtttggtaatattacgtaccataatcattcatttttttttaaaaaacaatatcacccacattatttatattttagttgaaacatgaaaaaatctttttttttcttctttatgcgatatgatgcgtggatatatttttacatatattttaattaggtgttgtatatgtataacccaaaataattattatatacctttcaattatgataattatagtgcatatagttaacaagatctgcattttcaaggccgtttgtttgagttttattttagtaataatttttaaaaaattttaaaaaattacaatattaatgagattctttaaattgtaatataagattcttttttaagttattgatacaatagaatatttattaactttatgaacgattaatctttgtaaaaaatttaaataattaacattagtcattaattggatacaattaactagacaaagaaccaattattgtagggtctttactcttaattcttttatacatcataatgaaattttacataaaaacattgagtctaattttatttagattaacatgttggtgtaagaatttaaaaaatatatcacaaaatttatttgttaacttaaacacaattatgaatttttatactaagagtttgcttttaaaaaaacaatgatttaagtgtttattcataattttgattataaatgagtaactaagacatacgactagttatttaaatgaatttttgggtaaaagtgataagttagagaaaagtgaatgacccaataagctgcagtgaaaccagcaactccggaggagaggtgaataacatatccgccagagaaatcaataaccccaagctttgctaaccagccatcggggcaccaaatgctaaaggcagtgacggtgtacgaaaaagtaagccaaagcggcacaaacagcatccacccacgaaagttcatcctcccgagcaacgccccagctatcaagatcaaagtgatccccgcaaaaacgccctgaaaaaacaccatcgtagcagtgggaaagaatcccagaaaagcttttcccagaagaaacttgtcgtccagcgccaccccgggtttccccaagaagaacaccattttctcgccgaatgacatacggaatccccacgccatccagtgaagaatcacgcttagcaagatcacgcctgggtggggcgtgactgcctcacctatcccgcctggtggagacgtgaccaaacacgtctggggagggcgcgaatggacctgaatcacgcctggctggggcgtgtttgaacactgcaatagatttgaaaatacttttgaaactgtcatattcttgtaattttttttttaaactgctattttttaatttttttgtcaacttatcatgaattctacttgtaaaaaacttaagaattgaaaactatatatagaaacaagtgcatccttatttacttgagtatatatacatacctggcaggtcctaaaaatatagagaaacttatgcctgttgatcaaggtctctcgcgcgagaaacacgccttaaagagctcccattttggcacagcaaatctagttctgggcaaagctgaaggatgactctttaatttatcaaagggagcagtacacatggattctattgactttccaaatctggaatttttaaaggcttatgcaatctccggcactgaaataaatttatatggctttgaagaatcagcccagtattgagcttgatctttttgagaggttacctgacacgggaaaataacatgtttttaagcaataatttcatcaagcatttgagtttaaccattagaggagcaaaaatctacaaatacctcttgaagaaaatctgcaactcccttgcaggatggaagtttgaagccaaatgattcaaaaaactccagcacgtctcctatggggccttgatattcaacgtacccctctgacagaagcagaagatcatcaaagagctcaaatgtttatggtgcaggttgaagtagagccattagaacagtagcatccatttggtgaacaaaatttcctatgcattacactacttgggatgtggtagagctatcagaacagtagcatccataaatagagcttttcgtggtccaacaatcatttctcttggagaaaaaaatatgaaaggcaaaagtatgtcattgcttgctacaatttttaacttcaattagtgccttcataatgtcttaatcttctggtatagacacagtcaaaacaaatatggattgaattttgtatcatctataaattattgttcctagaacaaatatggattcaaatgtatggactgtgttagcttctctattattatatattaatttccaatcttaggagtcaaaaacaaaattctaaatgaaatctccttaaatcttatcaaagctatatttcacaaaacaagaaaaaaatagagggactgaatttggaccctctttctttgtatgatacaagaggtaatccagttagattaacttaagcatatatcactacaagagccaaatttcaaagaaaattgtaacaaattcctagaaaggggagagagatcacctgttgtaactctcattttttggccaacagagaccccccttagcatatcattgcccacaaccgtatctgaacatacatcaagaccaaggcactttcaaaacataatctgtcttaacattgtggtttttgccaccaacaagtgttctgttgaggagtaaaatcagtttaaaaaaacacaaattagaggacttctcttaacttgcacatatgcatgatttttcagatattatttacaagatgaaacaaccttcatgaatgcatcaatttctggacttggcagtatgtttttctccttctccaagcgttcaagatttttcacaatttctgttcatgacattagaccaggaaattaagtaactgaattctgaaatggaaaataaaaataactaaaaatggcacataaggaaactaatatattatatacatatctatatcacttgaaccttggcatctgtttgcaaaatcaaaagtttgtctcactgtcagttctgatatgtgattatcagtttggctagtgtatgcaaaagccctttgaatacagaactcgttttgctcatggccattgtatgttatactaccacttttctgcacaggtatttaaggatcaaagttctaatgtaattctatgatgacaatggaattttgaagaatgctatggcgtatcaaaattcttggtatgctgacaattcagaaatggacttgttccagttagataaaggctataaaaatagaatcaatcttaattcctattggtataatgatttaaagcacattggtttcagtgtttcacttgttattgtgctataactggaatacactaacaagacgatcattcatgtaggcacaattttttactcaattcctattctataaaaataaaaaatgttgactaaataaggatgccctacgtaatagcttaatatttgtttcaaagaaccgaaaggtacctataatattagtaattacaaattgtaaagtaatacacgtatataacccacacggatgatggttatagagtttaatttccatgaactccaaaatttaaattgtcaatcaattatgaattataaagtagttatcgtaaatatcaactaacttactttatatgacagtttgtaacttaataacagtgtaaaaatcctgtacataataagtacatacaatatttattagtcataattaaattaatgttaattattagttctttaggaccgtagagaatgttaatcctgcatagaatttgtactaccttgaggttgctttcaagtttcctgcaagagccaaaagtaaggtagttttgcccgatcctggagttcctaacagcaacgtcatcctacacaacaacacataacgttaagcttgatattcattacgatataaacatatatgaaactctggaattttctccatagaaaaaattctattataaagtaattgagagagagaggaggtgggtaaagagggtggagcacggtctttataaaattagtagtagttgagagagagagggggtgggtaaagagggtggagcacggtctttataaaattaaaagtagttgagagagagagggggtgggtaaagagggtggagcacggtctttagttgttttgactatactttgtattttatattctaaattttaattattaatgttatttttttataataagttttgttaataatgttaaataaaaattaaatgtatttaatattttattgtacaaaattaatattttaatttagtgattaaaagtattattaagaaagatgatgtaaaaagatttaaaactgttggatgcgtggaagatgggtgttgctgatcaagtgcagaattcaattcaccccgtgacccgtaacaaattaaagtaaattctgcagtttctataatggcacatgtactccacatgcattctcataaagcaattattgatatatcatttgaaaagactccacacgatttctaacagggtatcaaacgaagcttcattaatattcatagcttagcatgggttcagcctggaaggaagacaagcccaactttgacccacttggtattttaaaaaggatttgatgatgcctatggtatgagtagtgtagcgggaacaatacaaatattaatctaatatataatcagcaagtagattcttatagtcagtatgatagctaatttattataaataaataaaatgatggttgcagaatcttcatcttaaaaaatattaatgtttactttcaattatgaccatagatatatttatatttttttttaaactaatattttttttgaaattttattgaggatgaaataatcacatatataatataaatgttatatacaattagttttttgaaaatcacatttaaaacaaacaaaattcatatataatgtagaaaataaacttaataaataattttatagcattttcatcatattattgtttgataagtcacctaatgtagcgtgcacttagtgtaacatgaaagtgcactgccattatttgattctccatccataaactccgctgtcaaacgtaatgagtaagtctgtgctatgtttgacattaagcaaaatgttacaaaattaaataagctattatgtcatactaaaaggtaactaaatttcagagttacttaacaaattatataattgtccaactttaatttgattaaaaaaaaattgaaacaactaactaatcaatatgttatgttggccttagtttggcacaccttgtgttgttactaagtgttctaataatgtataaattgcctttaaaaaaacaaaaaatacgtcatgtaattacattttatataaaattataaataatataacctgaatcttgttccttggaagttttccactaaatggaacaattgtgtttatagatccagtcatattagttttaaagctacacgtgtctatagataaggagactactctgcagatcagttggctaattttgcagttctcagtcgtaattatttttgctgggtttcagttccccctttttgctctcaccgttatgcccgtaattttaatgagctgctatgagttttgttgatttggctatggaccttggtctaatcctcccatattttgttttctttcttcctttgtatataaatttccgttgggtattggtataaaatcttagaaaataaggatgtcaatatagttgtgatattttttatatttttatgtcttatccgtcctttttaagaattatatataacttataatagtgtatgttttgatttcataaacattttttatagtctgaaaatcaaaagttaaaacgtgaataattttttaaacttttacctggccactttctacgtaatatatttcccacaattcctttcattgatcatacacgaaccatttttcaagactactgaaaaccttcatccttaaaatacttgattttatgatagaattaaaaattattataaaaaaactgatgtgacagttgcctccatcaatttatcagtttcagattctttttgtaaaagaacaattaaagttctctaaaaaaataattaatgtaacaacacgtacctaatttttaaaccagtcatcaatgccacaagcaagcaggtacattgcttatccattgtcttacttcctaattccactattcttaatacggccctaataaagctaccaaaattatcaaccattattttataaatgaaagagatacaaaaaaaaaaaaatagaatacttttcaaaatataagagactgcaagagtcttggattaaatttctctgggaatgtagtatgatattaaaaaaaatatcaaatttcaaaataaatcaatttaatcctatttttatactttttcttctctctttattattacaaatattcctcttaaaagcattatgctataaatgattgagtgttataaaagttgaaccagaaaaattgaactttaacctttatcggtatatataaatactaattttccttaattaaccacaatttacactggcctatcgattatatttcttgtttgattacatatctctagctctttgctcatgtcacaaccataaatactgccctcctaatcttacatcataggtattgccgaaggctttccccactcagagactccatttcctgcagaatttcctgagcaagagatttaactgaaagctccacatcctcaagcagttcgccaaggaaggggattgtttcagctatgaacactagatattcttctttcaagttctccacaaaatatttaacaattctgaggcccaatattttagctcgcaatttttcactccgtgtctgcatcaaaacctgcaaaaaacgggataaagaaggcagaaagatattcagttgctaaggaatactagtatttgcggggaacaaacatatagcattcaagagcaacacatattactgaatacccaaaactattaacaacaaactaatggactaaacttcaacacataaataaggcattgatgactacaaaggaccaaagctaacgtactatgaaatgggatgcaagagtacaggagcaagttcagatctttaaagatcattggccggtagggtaggtcaaaaccgcaggcgtcaattgacattattactaaagtttgatcaaaatgacataaaagctacagtctatttacaattaaaccttataaagcccgataaacatagcagaaaaggtcaactctaacatgactgaaaccctgttcagataaactattcaataagcacttacagaataaggaaaaaaagagcgtaaaatgaattaagcttctctcataagttaaaataaacttttatagaagttctgatttagcttctcaaaaaacttgttttaattcacgttaatttcaacttaagaaactcaatccattttacctacttattttattctcttagaagttcttgttgagagttttcccaaatagtacatgattttactatgcttaggtgatgttgataggtagttgttagcaaggccacaaatggaggtctagcaaaggaagttttggtaaggatttgctcgtttttctagtttgaatgactaatgttagaaactccacgtttgaacctgctggcatttctaggagcccatttgccccgtccagcttgttggcttgctgctgcaccacagctactgactgaatgtttacatgtaagaggagtggattcgttaaattaaaagttttggggggccatatctgtatttacacttttattatggcctttagagagttaattacttctactgttagacatattcttaatctattgttaaaatgtcttggggcatccatgcacccaaactaatagggagaatagtagaaccagtcatattcataacagtgtttcccgaggacaatgatcatatgcattttccctcaatgaaaaacaagatagtgaagccagtaagttaccagtatgtcagtatcaaattacttgcccaatcattaacgagtagtaaaaatgaaaagaaatcataaagttcacctcatgattcaaaggtttccacaaaaggtcagatctagcagtcactgccatttgaccgatgcacacaaccagtaggtcatcaacttccttcacacttagtatatttatgctgtcatccaacagagctggtggatctacaacaagttgtgaaacaatgggtctcaacaacatctgcagcaagcatgacataacagtcagtgagagaatatagcaagcaactatattactgaaggaagctgaaagacttaggaatattttattcctcaatggaatgagaaaacatgcaaagtatttttaaatggaaaggaaaaattcccaattaatgcataacctttaaaaaattccactctaggtggaaaaaaagtcttctaaagaattttttcataaccatttcaaatggtaaaaatagatattgatgcccatgcgatacatatatcagatatgaaaagtatctgacatgactgcaattattctaaaaatgtataggataggataggtataagatataaatctagacatgtaaaaaaaattctgcaaattcaaattaaaagcatacttcctgcacattatttaaaaagtataaatcatcgtaaatcaagtcctattaatctaccaacaaaatagtatcaatctcattacttttttgagatcatccataaagaggatagtttccattttggtgcatcaatggacaatgcttcaatttttatacatgcttctatgtctcaatatgtaaactatattagattttcatatctttaaaaaggcttgatgcttcacagacgcgtatcagtgaagtattcaaaagttatggtatcggatacgaatagatgaaaaaatgagttcttagtatgtaaacaattcacttgcctggaaatttgaggagtcaagaaacttcaaggtcccagtgtcgtacaagaaacacttatgtaaggatgacaagactagagccctgagatgccagcccttgatagacacactgcctatttcttttatattgccatcatctagaatcctggcctttttcttccgattcactctagacacttccacatctccaccatcgctaagatgatgaacacaactaccaagcaagtgtttgaagtagggaacaaacaatgacctacaaataaggatatagaccatcttaaactgctgtgatttgatcattattttgggtaaacaaggtaacatcataacaagtgattatattcttatgtttattggcataaacataaaaaataattaaggaaatcaaattgaaaactaactactgatttaaatactgcgaccaaattgtacaagtctcaactgtcacaagtggttgacatatttacagtggttcaaaacccaattttcgtatctacatcacatgtacataatttaatacaaacaaaaagctaaactcttcttctgagaatacaaaatatacccaaaatatttagaaacccaaataaagtgttgtttgactaaattcaaagcatgcttatttcaaagaacattttctaaagcgaacaataactagctaactaaatactgacttaccgatggctctcagtaagcttatttaccatgccatagaatgatatggccctatcaatgcttccgctggatgcagtttcatccacttcagattctgcccactcaatactctttatcagaagaggcttgaacatgctctcagtaagttttaaggttagaacagtcattgtgttaagcacacctttttccactacatcaatgttttgaactgaaggaggactttgacggcgcagatcaagagcaaccaaacaatggtcaaatatctttccatggaatgccacaatagatgatctgtccattgtaccaattatggttcccaacatatcaaatacaattgttaagcttttatccccagcctcaatggcagctgggtataattttaacaaaggtggcagggcaagtcgaacctgtaaaaaaatagtgattggtaaagaaaaaaatgggtatttcatttcataccacaattacacaatgctacattataacaagtcttacaggaattttttcagcaagaagctttcgtactccatgagctctagactccacctttacatccattcctgaaacacattcaggataaagcaccagaagctccattatatttgtaagatacggatttaaaaatccaccaagcttgtccacaactgcctccaaagtgatgagaacataaaaatgggattcatttaaggctgataaaacatcggtggtttcgggtttcatatccaaactagccaatacttgacgagatgacttcatcacattgtccataatcttgggaagttctgccagtgattttggacctagaacattgatcagggcagcagttgttctgaggcagctagaagtcacagccaagttatgagatgcaatatgtcttgtaacagatccaaggcacagactaaagatggaattattcgaaggaaatctttcagctagaacttctaatgctgaaactgctgccactttcaaggaggtatttgatgaatcatcaagtactcgaataatttctaaacacaatttattaagtgattcttgagaagtttcactcatatgaagcaaaagaaaacttggagttgaccttgaacctttattgtctttaagctttaaactgacatttttatgatttcttgcagcctcacataacagcccaagagcctgcagcacaagaaatacaaatatcaaatcacagttctcactgtcttgctttcacaccacaaaaaagatgtggatttctataccgtgctcatggtgtgcaaacattggaagactcttatgtttttcgatatatcaatactttcttttctattaaaaacttggggcgtttacttgcacttctattgtctgttttctttagtcacaaaaatgtcaccttgttttcaatttgtttccgattgtcaaatcaggaaatggagggggaaaaaagtttttagcgcttcctatacaaataaatgtaaacaggaaacagattgaaaacaaggtggtatttttgtaattaaaaagtgaaaacagaaaatgaaaacaggaaacaaaagtgcaagtaatcacccccttagtatttttggcttcttattgtgcgctcatgctcacatattaaaaggcaaataaataatttaccaagatgtgtggtcaataccaactaaacaatttacagtgtatatagaaccaactgtattcataacatgtgaataaaacccaatcatcatatgaaaaaagaataaatgaccactgtgtatacagtatacccaccaaattaagtaaacatcttgaaaatcaggatgtttaatagaatactatgaagcagataaatacaccaccaaattgtagtttaccactttacccttgtatcaaaataatacaagatcctaataaaatctcatattttgtaacttcattaaaaaccataccttttttccaacattcttgtctgcatggcgaagcaatttaattatgctctcaaagtatatgacaggtatcataactgttgttagattccttgcaagtgcatgcatagtttctttcaactctgtcctcagaattacagggaaattcagttgctttttccttgcatctacaagttgcatgagtaaaacaacatgctccataagcgcacccaatgccctctgaaatattcaagaagcgatcacatttatttttattatgaatatgttcatctaaataaacaagagaatataggcttattcaaagattagaacatttgcaaaacaaaaaaaaaatataagcatgcaacacttatgccattgctatcacaataagaaaccaaaaacagcatctcaacattaaacctacaaagaaaaaacaaaatatgacatattctacaaagaatatttcagttcaggttttgataatgaatattgttggatagttgtctaaattccagtcacacctagccttagttgtggcctctttgggggttgccttaattgcaacctcaagggtggtaatttagtcccacatcaactagacatgtggttaaatagaacttatcaagcttgggcagtcctcaccttgcaagccagtttggtcgggttgaattagggccctaagtccaatttctgataaatatgttcatctaaaaaaaaacaagtgtttataggcttattcaaagatcaaaacattaacacaaatataagaagcatgcaacatcaatgccattgcactcacactaaaaccaaagacagcatctcagcatgaaacctacaaagaaaaggaaaacaaatatgatataaattcttctacaaagaatgaatatttcagttcataatatgaaatctgcttctgcttcgatatcttcgtaagatctgtccctcaccttaaaatcacaatttctgattgatagaaatttaacttcatcatgtgtatcatactattttgtcaggcaaattacattgacaccccttaaacttacattcaatatttttttttaccccacacatacctccttcaattaataaatcagggaagatatatgttaatgataggatccaattgcaggctatgggaatcaagttgtacattagaagtatgcaattctagcgaggtttataaggcctcgggctctctaactaagtacaacggctagcttttgtggtgttgctctcccaaagttcttatcaattggtatcaaagctttccaccatgtcccttagcctgcacacaagcagcaagggtggtgacgccacattgcagccagtgggtgtcaacatagtatccccaaatttatgagttaagagatatcaacatctcaaaaacatactgtatgtatctgctagtcattattgggcatgggtcaggcaaaaatagaagctattcataaaaatcataatataagttacatctagactttgccttatagaactgaataaagacattaaaaagcatacaagtatctagcatgcatctgatatggatttatacctgaatgactgaggtatcttcacctgatttcaacttaaacacaaattctggatcttgcaacttttgcaaagaaaattgcattacaataaacaattccagaaacattgcctggtcaacatcactatttcccctctgttcaagcagtatgactaaagaaggaagccaaatcgtacttgtatattgttcacaaatttgcactgcaaatttatattcccactcctcattataaaatgttaaaacatcttgcatctcaacattaaggaaacaggcagctttccttgaaattaatgaacggaaaagtaggataagcaatgaggctaagcttttaccctcacccaaagttctgcaaaacagccatcattataagacacaggcaaaaaaccgatggctgaagtatcaatagcaggatcatgatgtagaagtagaacaagaataccttaatagatataacacaaatgacagccttctgtgctcaacaatttcaggcaatatattcatgaaaatctggaggaaaaaaaaacatattagtaggttgaactgctaagagattcttttgtatcaagcagcagaagatcatttatgtgaaaaacaaaccttcagtaatttctccacatcatctgtcttagccagccaacacggaacaattgcagatataagatcctcaaaaacatgcttcgaatgactgtcaatctacaggcacacaaaaaagagaaatgatgacaccacagttcctacactggattattagtccctaataaattgaattgtgaagaatttctattaaatactgcaactaaaagttaagttgcaacagttaataagtaaggtcatccaacaattgaggtaggtgatgtaggattttccagtttccacaccccctccccttccacagatgcctgctgaccaagtgatgcacaaaggaaactcggaaatgacagaaatggctggaggctttgataccatgttagatttcatcttaaaactaattggcattaagtgaggttgtccgacaagtataaaaaccacgccctagtaatcgaggtaggagttgtggaactttccaacaagcatggaaacataagaaaaggatgtaataagctattctacacaaataacattgttccccagggaagaaaaggatctaataagctactctaccaaaagaatgccctaagttcagtacagggaaaccctgtattaacaaacctgtgtgacagctgcttgtccaataacttctagaatatcaagcatatgctccaaaacttctcctggaaagactctggtaacagcagagagaacagaaaatacatggttgcgggtgactgcaactgtggaattccgggcgcactctatcaatagcttaatgttaatttcatttgtcattttttcctgtcaacaatggcaaaacttaataatataaggaaatagctaaaatagtgaaaaggtagtcaaaataatatttctaacaacataataaattttccagcttcacaaggcatacatttaacggatccatgcttttaagagaaataattatatcctccaggattatcaacagagtctgttgaatatgatatattgtgtaattgttggcttccgaaggacttgaaggttggcttaactttatcttcggggaaaaggcaccattcacccattcttctgaaaataccttgctaagaagcttaaataagggccctaaaagtaaatgcctgcaacaatcaaactgagaatttagcacagttaaatgttttaactactcatctcagcagtacccataatgtaatgttcagattcagaagtaaccaagtcacctgtttgttatgtccttcttcagtagcaaaacatcaagaagggaactaaggatgtagactgcattaactcttctgaatatgtcattaggaggatatcctgcttcttgatgtcctatgaatttttgtttcttcaccatcttttcttctgctgaactacttatacaactcttctgtgcaagtataagatcaagcatgtggccaacagttgagaaactaatctgcaattccaatatatccaccaattattcttaatttcatttcttttttttccttccgtggaataaaaagttggaaaaaacctcccatacaatgaaaagaaacaacaacaaattcttaccccacaaggtgagattggacattgaagagcatagtgcaaaacaaacaacaaataacattgatagtgcaaaacaaccagttgatccaaaaaggcttcggtcagataacaatggaatttacattgttaaaatttatcctcaggtcactaccatattaactgtttaaggatttttaaaagaaaacatttatcttatcatttaaaaaaatctacaatcaattgatgaataatgacatatcatccattttgtcaattgatgaatttgaagctaaacacccagcagataatgatgaaacacctgtttcacagtgaaatctgctatcaaataaaaagcaaggaacagaacagaacagtgacacagataacggaggatagaacacaaggctgccaagttcaacagccagaaaccatcacggtctgattgggaatagatggaaatactgccatagaaagagagaggccatgatttgtccagaatcagagagcacaaagctaaaactacggagctcattaaccacagtaaaggggaaaaggatccaagatccacaaccccaccccccggaaaaagaaataaaataaaataaacacccttcttaaagggatgaaaaccccaaaggtccagattgaaaccaaaagattaagttctttgcaagtaaccactaaagaaatcgcacacagaacacatgatatttgatcaagagcaaggaactcacatctatgcacattaatgcctctttagttgcacgttgtacatcaccattatcattatgccacaaaatcacgagctcacaaaatagatgctcctgacaggcataagaaaaaactattagtttaggtcacagtaaaagctacattggtgataattattttatttacacaatgaaacagattatcataaactcattaactagatcattagctatactcatcaattatcatgaatgacaacaacaaactctgaaaataaatagatatactgccaataagaccttcacttcattcttcaacttcatatagaattgattgttaagtttgttcaagacagtgatacaaggctttacacaggcagggtcatctgatgtcatgccgcccaactgaaagatcccaagaatgaagtcagtaaattcaaaataacaagacatgacataagtaaaacacacatcttaatatcttacccgcaaagctttcagtaaaagatgttgaagatcatttccaccagagggagatgacataacacagctctacgcatgaagaagaacaagttcacatcaaacctcataataaagatcccataagctaaaactaaaatatacaatacacatacctccagcaaaaggcacattatctgagtttcagtgtttgacaactttggacaagacttattgagctcattatagtactgctccagaaaagaagacaacaacggcccaacttctggaacgtgcataagggcattcccaattcctttgaataaggataaaatcattagctgcatccaacatcaacaaataagttacttccttaaagtctcggcatagcacaaaaaaccctcacttaacactgttaatctggaactgaacatatgaaaccttgatctgtatctctatctccacaactaaaaatataatagaaacatagaagagcgttaagacatcaaaccttcccatagttagagaatttaagagtggaacccaaaatgaagccaagaatttttatttttgtaggctggtcaaacctgaaaagatatgtttgggaacaaagtggaataaagaatcttagaaattagtacaaatgaacatttttaatgaatgaagataaggaacattcttgaaaaaaataaaaacagaaactaacaagcaaaatgaaaaggtaaaagtaatatggggaaagttacaagataagactcacagatatatgcatcaaacaatgagcgtaagtatcagaaccaataacaacagaatattctaaacctattctatcccaacaatcaatctcaataacacaaaacagcagcttaaagtccactaaaaaggtaagccgcacaacacgtaacattaaacaaacaaaaacactaaagcttatatgtaaagaaaataaaacaatgttaaagtctatatgtgactgtacatgatgtgtcaaattttatattgccaccaaatcctacctttcattatcctttaatgctttcatggtgacccaaaaggatcgcttcgggacgcttatgagattctagtttataatgtcatattttcatttaattaatggtcgctggcttctttgattgtagagagtctctactagagacttgtctttatgtatggtacataaagcaactttgcctgcttgaactttcttaggaagagagtatatttacaattagtatttttgcaatgactccattcatggctatatcttcatagcccaaaaggaaacactagccaagaactcttatcacaatctcgtcagcactcagcaaggaaaaaagaatcaaaagcaataaaaatacaaaggccgggcccatgtagcaggaagagaaaacagttaatcaagtgattggttcagtgaatcaatcctggccttttttagattaaaggagaaggaaggaatagggtttgatgttatataaaatttgacacttaatgtcaattggtcatataatagagacacatacacatgcacactaaagcctaaggatgcaatttaataaaatactccaaactagtgtcatattgcttagtttggaatttatcataatttcttgtttcaagtttatcgaagaattcatctagaggaaataaataaggacaagaagaagataagcaatcattctagaacaaccataataaagaagtagaacaacacaatagataaaaacagctctcaagtgaaaacccataattacaaaatttataagcaatataattgattagcatttgtactaagttaggattttgaataaacaggttttgaataaaaataggatcattcaactgtcaagttaaggttccatcctacagtttatgcattggttcagtaccattttaattctcagctgtttataatatatatgtatatatatatatatatatagtcacatttaacattgaatgaacctcctagagaaccctctatgccatctacctaaatttccatttctttctcctcccacccttaaatttactttccccttccctgtatgactttatttgtgtcatgcatccctccaatccttatgaactttgagttgttacaatggggacaatgaacagcaacagaaccatcatttcccgtgacaaagggaaatttactgtcagttgtcaaacattatatcatttagattttaaaaagaaaaggggaatgctgctctccacatttaagaagatctagctaattccaacaacagaacaagagagcatggtcatatttgatgagcagcagctaaggcaatgaatataacaaatagttctaaggtaataatattggtgacaatgaaatgataattgtcatagtaacatcataaataccttttttctatattttgaggtaccaagatatttcgaggctccaagatgtttggacaggatgagctcatagcagacgcaaacaatgagggaagaaatttcttgtcagacaatatgaatgttttttgctgatccatcaacgccaaaacatcacccacaaaatggatccacattgcattgttacctgttcatatcaatttagaaacttataaagttccaaggtaaaattaattaggcattgagggctacatcaaattattctgacaatggagtaccatttttctttccagaacgctcaacatgacaccacaatgtacgcaatgaatcgatacagttcaaggcagcaacccttatagtctggaagaaaattcaaaacgatgcaaagaaatcatttgagcacattttctcagaaagaaaaaagccaaaaaagtaacagaggataaccatttgtcaacaattataaattggcagtttgcagaaaatgagaaaaaatacacacaaggtcagagagtaacgctaacaaagaatcatacctgattatcactcgccaatggaacaagaacagaaggaaattcagctaaaagttcaatttgccatttatcttgtgacaggctacaaagaaatgcatagcattgaagactttcaacctggactgcagcaggaacacctgcagaatgaaagattcaaccaaaaaatatcaaatatgccaattgaattttatctgacttctgattcataaaatgttaaaaatatcaattcaaacaaccatgatttcaatcaactccctccccctcccccccccccccccccccaaaaaaaaaaaaactataacttaattgcatttgcatagatggacgaaacaaactggagttgggcttatatgtagtaatgcaaaaaatattattgctttagactggagtcagacatacatagatatacacaagctcttttgacgtgagataaacctcactgactcgaccgatatcttgatctgctttggagagaaaatgtgatggaataagttcttctcatccaagtgaacagaaatcatgtccaagaaagtatcaaaggagcagatgcaaggatcaaaggagtttttggtggaggtgctttcagatttaggataatatcttagcttttaaatgaatttgaaggggaaaccattgatgaacaccaaaatacagcgtttgataccaagttagattttaagaaccaaagagaaagttggcaagagagatttgagagaaaaagattgttctagatctgaaatcaaaacatattcaaaagtgtatcacctctgaatctgttacaatagagtgaacccataactgtctctaactaaaaactggcagcttacttctgactgaatacaagtcaaacaagtaggatacagaaagcctaacacaaaacagccactttaacacctaaacatggattggtcaggatgaaaatgcccctaacgggggatggaaggatttatcagggatatacaaaataattgaaaatggagtaaaaagaataggaaaaggagaaagaatggaaatagaaagagaataactacaaatataaattttgtaccttctaaacagcaaatatgtgtgtctgcgtgtattcattattatgcatgagagatcatgataattacagaaaaaatagttctattctctccctttgaaatacgaacattttaggagaatagagctcctttaatgattatttttccaagtatcctagatacttggtatagtcaggatcaatgcatcttaggaagtagtggcatctaaattgttctcttgttaaattgtttcggcattgattatctttgcaatattgttgaatataaacagttcactctactgggtagaaaatacaatcaagtacattcagaaaattttctttctcattttctacaccataacacaggcagtaatttcacagtagaaggaacacaacattggccaagtaaaatatgggaaaaatcaaacaaaaggaataagtgtatagcaccttcttctgtgaaaaacttagataagaggcggggaggtgatattctgcactgcgctgctaagtaatggaggtgttcatggaatgcatgcttcaatttagatgaagcaaaaaatacaaacagatcccttatcttgctgacccacttatcatcgtcatgctgcattttgaaaaaggttaatatccaaccaatgttgacggtgagagtctaacaacaacaaattccaagaaggaaagcaagttcataagacaatagataacaggattacaaatagtaaaggaattacttacaagcagaatgtcagaagttagtactgatattagttgtgctagcctccaaaatatgcaaatcataagcttcacattaagatggctcagcttgacatacaaaagatcattaaagaatgcactgcaatcccagtctaacacttcagacttgaactgcaaaacaacccgaattcccaacaatcaaaacagaagtaaaacattagcttctcattacaaaaaaagtaaacaaataatgaaataaaagcacaaatatgctagtaaatcctttgtacctcatccaatgagacatcaccagctgtcactgacgtttcccactcagcctttagaataggaaatacacattcaaatagtgcacaaatgtcttcatctttgatcaaaaggaaaaagtcaatatttatcattccttagtcccctcttgaaattttttggctaagaaatctaatagagaagacaaaagtacaactatgggatgtataagatatgcttcaaacatttatttctagcttatttgttcaaacattacttgtttttagtcattatacgatataagattattaactatttctgaaaaatattaaaatggaattcaaaaagagaaggggaaaacaaaccttttggttttatcaaaagagactgcaaaagaacaaaaaagaagagtgtctttgacaactccaaatcactgcagctttcaacaaaccaagctatatgctctttgggatggaccatgaaattcttagccatgttatcaatagtcttcaagttaattgaagataaacttccaggtatcaatgtctgcgattttacttcaagagtcactaaagtaaaagatgattgacaatttcatctgacataaacatattcatgaattgttgtgattactgattaacaacttagaaatatgatgaaaccaaaaatatctttttagaaaacccacactacaagtactactagtaagtagtaacatatcatgttcatgtactagactattcatggtgcaattgggttattccctacataatatctgtaaaaaatgtgcatttcaaatttcaaagttttggttttccaaaggagacaggacctaatgcttgattcatatcttcagttcaccttggaaaattctttataggatcttcagtttgacaaatttgccttgttgagcaacagaattaaatttcttcatattgtaagtgtacgttaaatttatagcaaactaattccaaagtagatatttaccccttctccaaaagaagatacaacaatattctgataaagtggccagtttattttgttgacaagtcccaaagcctttaaattcaagctctgtgtctgcgcatggcaaaataagttattatttgataattacccagagacgggaaaatctaaaagctattaaataagtacaagatcaaaatatattaattttctatccgaaaaacaaatattaaatatgatgttaaccactacctgtggtagaacaaggagtaatggaaaaatcatagcagcaacattcttcaagtaatcagcatgatcactgaagtaggagatggcattctttagacaagtgacagcaacttcaacatttagactatagttatcagctgaacctacaagaagagaatgggtgcataatacatgcagtgaattaagagcataatttttttttattcagttatgtaatcctcccacccaatcttgggatagatgcatcatcgttgaatgaatcattagtaaggaaccaagcaaagaccatttgtttaaagaatatctaaatacaaacatctctgggaagccaaattcatccttatccatggttacaacagaactgaaataagtttacttgtcaaagacaggaaacaactagccataacttaatgaggacaaatatactccagtaacagaagcacaactggaataagtgtatgaaatgaaggttatatgcttatatgtatctagtcaacataaagtaaaagcatattttgataaaataaacataaaaatggacaaccagacacccttcaaaaagaaaagggaaataatataagttcaatagagtaaatcaatcccaaaatacacagaagaataagcataagcatattttgaaccattggaaacacattaaggaagcttagacatttatgagaccacatctgtattctgcacgtaaccccaccatcccctaacagtcatcaatcatcatccatcaagaatgcattcaaagaacaaattccttttcccagtttatggataaatcgatgcatggtatgtattgcttcaatacaacatgcagaaacaataaagatgatatctatctaattatttttaatataccacaaattacctgacagcagtttgccagtgcatctttttagcacattctgtagtgcatcaagaagcttagaagaatctattacatttcgcaagccatcaacacgtaaagctgcttgaacaactgttagatctttatcatcaagctgtcttaagatgtcctcttggatgcttacaagattctgataaaaaagatgacttttggggttagctaaaggttgaagactttgaatatggaaaaacagtattaacacatcctagcaagaactttgaccatattataaagatttccctaagtcaacatgaaatcaacccataatttcacataaaaacagcataacccacgtgataatcaattaatttatggcttataaatataattaattatagcataccaagtactaaataatggtaccattggtactgagtacttcttactagcaattggtgtttgtgtttgacaatgaagcatgatgcaataaatttttatagcattttccaccaccacactttcttttggacagatttgtgcccttgagttcatcgtggttcaaggctcagtttacagaggggtttcacttttgcattttgacagtgttgtaaagatatcaggtttaatattgagttctgtggtcttcactttttgctaagcctttattacctggctcggttcaaatgaagttgaggtggcttttgagggatatatactcctccctccttgtacacctactctttcaaatgaagttttctaacaaaaatcaattataccctccctcaccaacaatgtgtaaaatcagtggccttgacaaattagatcacaaatgcatctcagttcaaatcattcaaaatggaacttaaatgtatcaaaaaatatttccaaataaaactagtttgacagcaaaattttgtaatgcaaccatttcctaaaaataaaaataaaaaatcaaagagaagtaatatgccaccaccatcagaaattacacacacttaaagaggaattaatttacaccgttgtaaatcacacttactcttacatcattatgaaatgtaatttttgccaactattgaattataattatatattaccaaaattatctatgtcaaatcttctaaaatatgaacaacaataagaagaaaatcgaatgggtttgattttatatgtcagaagtatatataacattaattttgaagaactgaatgatgtataaaaaaaattgaattaatctaaaattctgtagatatgataggaacttttaatccaacaatgggtaacgagataaatttatccaataaaaagttactgaatgatgtaagtgttggtaccaagcaatcacacaacaatcgagagagcggaaagagaagaaaaggaagaagaaaataacacgtagtgtttacgctggttcacccaatgtgggctacgtccaactattctctatattttcctcacacactcgttacaatgtactcagattacaaggaaatatataggtttagggtccctaagcatagtagctattcatgggtccaagcccaaactacaaataataaaactcaaggtcaacatcagaaaacaatccctcattgtgtgtgtgtgcaaaacagaaaacacatcaagcaaaattttaatagttctgccacccaaaaagagaaacatcaaggctgttcttcaaccagtgtcataaatgaaaaatacaaatttcaaacatgcagttttgggaggacagatatataaaggaaataaaccacatcaagcaagaagtttcaacttttttccaaccaaaaggagcacatcaaagatgttcttcaaacattgtcataaacaaaaaatacaaattaatggaaacatgaggttttgggaggacgagaagattaacagagcatatatacctctgaaccaactgccttggttttcaggataacggaattatttaaatcaagcagcgtagcacgtcgaacatcagcctagaccaccatatcaaatataaatcatgaagctcttacaattataaaaaaattatcattgttgaacaggagaatacatacttttatatttacatacacctaataatcaagaataggtcaacgattgatacctttggatgatacaggcccaaccaaatatttgagtctgaaataccaagtgacgaatccatactcccatccaacatcttacataaaaccttatacaatgaatcatctttcttagaatgtcctttattatcctgttgaacatgttcaaagttcaagccattatatactatctgacaatgcatgacaacaacaaaaaagcagacaactcatcagcatacctgaaggaaatgatgagcagcacctcgtaattcagaagggtattttgtattgacaacaaacagaatcttttttgcccacccaactaatcaacatttggcaaaccaacattatgagaataataagctaggcaacaaatgataactgactagttgtagatttctagtaaaaaagataaaggtaaaccatatggagctaaatgattaaaaaaaaaaaaacaccataagaaaagaaaacaaaattattcaggagcaaaacctgacaataataatttacacagaaatcaacgaaacttcttcaaaagaaatttgaatttccaagctgaagcaagtaaaacaaagtacactgactaatgaagacataacatgcatgcatgatacacatagacaaatcataagccatatagtgagatacacaatttgaagatatctagttcattagagggtttgtttacaacacaccaaatttgttttaaatcacttattcaactgctttaaagcagtttcacactcaaacttggccaaaacagagttggtatcaacaaggattgttagcagcattaatgtataggacagtagtatgtgcaatttcctgtcttcataagtatctttcatggtctctgggtttctttataaatctatttatttacagttgaaaaaaaagagtatgtagtttcttaacaaataaaacttcccttcctgaaggcacacattagacttcaacatcaaattccaattttcttttatcagtttcaacacagggttaaactgttaaagaatggagtaagattctttgaaaacaaggcattgtaaccagcgtaatccaagagtttggctcttaattgagaaatgcttttcatactgtagaaatggagagtgatgacagcatttggtataatgcaatgcttttgttctggtgtttcaaacaccagttcttactatttatacagtctggacaaacattttattacttacataatattgatatagaaaacaaattaactgctaagtaaaccacttttaatatcatgtatctattgcatgtttgaaaagttctgtgtcggggggaataatttccagataagctgccaaaaaaatttcttcgcctccaaaataagcttatacaaacacaaagtaagatcttcatggtgaaagaaatttccaagtaacttaaaatgcatccatggtcattgctttcagaattcagaagaacattttcacacaggtattcaaacaatttttttacagaagtttagatgagatttctcaatcaccaaatgagattttcattaaatattattttcttcagaaatttattgattcactcttggtatgaattattagatcaaccttatgaagcacaccaggatatataatttggggtacaggatagtgatcagcattctaaaattcaaaatcagaatacacacctgacatggaagaagttgagtcgctaactttttgtgataatttcacacaatttgaaaggatcttggtgaccacatgataaacaagaccatgtacggggactttttctattaaggatagcaaagtccgctgacagtattcatctgaagaactgcaaatgtgttattgttataatcagcataaaacacaagcttctataagatatgacttaaagcatatatctcctgaaagacaatcataggaaacacacctgcagtcaatcagggagtccaaaagcacgaggagaaacttttcgatattgaactccttagataattctaataaaacccctgccaggtccctatatgaaaagggatttaataaatcataaatataaataaagaaaaggcaacagtcaaagcacagtgattatgcatatgatgagaagttcgaggaagactaccttatttcctttaatatctccaaggccttcaatgggagtatttcaacattttgagactaagaaaattccaacagaacaaattaaaataaaaatatagccattcagaaatagatattgcacaatgaaaggaaattggatgaaataccaattacaccacccccccccccaacaaaaaaaaggattaatgcctccgtttaaaccatacacaagcacacaggattacactagtacctgaacaagactaattaaggtaataagggacaaccgaaaccaatggagatctgtcaactctgtagcctcctgacgagcaacctcggcaaccaaacgtatcaaactattcaaaagtttaggagctaatgcagttttgtttccaagcaaaccaatgatcataagagaaccagcctgcaaatagaaaaccaaaaaagaaagcacaagaaagtgagcttccagctgctaattgtaaataaggacaatttgacaacaaaaaaaatgcaggagagggagccaagaaacatagctcaaatacacaagtatacatatattgttggaatatgtgaaaatattttatcatatgttagagtatcttagattatgttttaggattagtcttcctatacttccattatctctcaggattgctctatgattaacataaataagagttagtacttcggatttcatgaatataccatccaagacatggcaattcatcgtaataatcagttttttttttttgatcagcaaaagtatatattatatatatgagaaaaaaggatagatacaaaaagaaagcagaaaacagtccatgataacaaaacccagcctatggcacactaatacatagaaaacatgaattaaggtgccataaacaggatggacctaaaaccccccagacaggtgagagagattaaacagtcccctgcttacaaaaaatatccctaaggttgcaagcccaaacgtggaaaggcatgtgaaagcctttctccaaatttttgcaccacaaccaacataaaaagtaaggtcaaataatcagtagaatatcattcaaagcttctattctcttctttaactccctctatacctaaaaccccataatttcaacagatcaaataagcactaaaagtaaggtcacccagtcatataatcatattttatgactatactaacataaaaaattatgcactactattcctatctgtgatgaataatattacactggtggatattgtagagcaaaagagcaaatttatttcgcagtctaccatttgatagcaattacattgcctactaatgagaaggtaatcacaaaaatatgacagtatgatacccaactataatcagttttaaaatttaatacatggaaaataatttcctaggaagctaaccttgtgatctgaaacccccttaatgccaggctgaagactcacaaagggaagtatcctctttacaagatcatcatcaacagtcacaacagtacccaaaacttcaacgaaaacagcagtacaaaagcgaattgcaggcattgaaggtcgagacttttttgacggagatgcctgtaaccaaatccttagccatataattatttgattccactagagaacttccacattcacaactaaacgcaaaacaattactcacatagttgcatagagcgtctaatatgcccttatcacggatgcactgctgcactatgaccattctaggcagccgtgcaccagaggctttcacaccatcaagaaacccccatttagtattccttcacataaattaacagaaacatcagaagcctctccaaccagtagtagtctacatcacaaccaaaccaaaaacacataataatatcttcctaaccttgtatcaagtatctgtactattcgaacaaattcaggctcgtcgtggtacggcaaagcacacaaaatcaaatcctcgttgttgtatacatgaatcctgaaactcaaaacaaccacatcaaaaatcacaaaaaaggtaaactaggcagaggcaaaatgtgattatcaacacaacacccctaggaagaaaacaattcataatacattgttgaaagctcacttgtgtctacgtatcaagtactcaagcgtttgaagggcggccgtatgaagaaaatatccagaaagtagtttcaagtatgaagcaatggagacattaagttgattgttctgttctattcccatcaactctctatccaactctatacgcctgtggttaaacaaatcgttcttatggttcctgaaccgctcatccatgccaataagaatctctaagcctgaaatattgcatcacataagaaaaacagaacaaaatcaaacgaaaatagaatataaagtagcaccgtaattcatatgtattaagaaaaacccaagtccgacgttgtctagagatagtgtcaagatagagtatataagtgggggataatcctcaccctatgagctagcttttggggtagggttgagttaggtccaaacccatattctaagaatatgctccatgttaatcactgagaaattaattcggtttactggattgctttagttgcactagctatgttgaaaagagcgaaattaaaaatgagaagattgacctcgaagagcttcggtgaaaatagcctcggtggagatgtcagccgcttttttgggatcatacaagatggaagggcgagtgagtggcctcttgagagggtcagagtcggttttggcgaaggatctgatagcttctaattgcgacgctatggaggacgccattgctagggtttcgtaccaaaacgaagcttaaacgtttgattttggtttcagttttggttcttctgcttatgcttcttcttgctgtctgcagaacttaaaagtcaagagtgtgagagaaccaactgttatattgatttacggctttcgcgctgagctgctggtagggtttagggtttttgtgtttaccaaccattaatgtcccttcctaaacgacgtagttcctctctctaataaataacaggctgaataatggtccactttaatcaatatttttatttaaatataaataaatagttaattttttatttgttcttttatttatttatatgttatttaatttaattataaaattttattgaaatataaatataggtagaagtctcaaatcgaataaatataaaaaagttaaacattatataaataaaaaaaatacttataaatgtgagttttaaaattttaaattaagatatgatattaaatttatttatataatttttaataattcattagtataaatttttttatgtttatcagacacaaaataattaaaattttatctcatactctaataattttatttttaaatataattacaatctattattaagtaatctgtatcctatgatttgaaaaatatattagagatatataaaatttataataatttatctttaaaatatataagtaattggttgtgcaacaaactcgtaaaataaagggagaaaaaataaattttgaatttaagaagaaaaaaaatgaaagacatggaattttgaaagaaaaaaaatcttaaaatcattttgtcttatgctttttctcatttttttttaaatattgcttctattttttctttttattttttatctcttactctttaaacaagcatacaatttgagtaaataattagcaaattaactaaattcgtatttttctaaaatgtaagttcatatctttaaccaaatatacagttagacaaacttcaccaaaatatattaaacatacaaagcgatattgtttaattcatcaaagaattgtgtatattagaaaattgggttttctaatgttgagttaaatataatggaaataaaatttgagtcaatggacccaatactatatattaaaaggacaagactctacctttgtccagcataggtgcacatggataatttatgcgcacacccacatgattaagtttgaaactctcaacagtgaggagattgttcgtaatgttattgatagtgatttattgggatggatttggacatttttatgtttgtaaccttcattaataatttttataacttataaaaaagccttatatagtattaaaaaaaatacagtttttttatgaatttttcagcataaatttggataattttataagatttttttagtataacactcaacaaattattacactaaactcttgagattttctaatatttttttctttttttattgttgatcaggcttttcttttatttaatcacacataatatatttttcttttcgttaaaaatgatatacacattcataaatttcttcataaaaaacgtcattatgataatgaattttcaattgaattaacatatgattcattattttcagtattatcaattaacaaatatcataaatttaaatttttggttcaaatccaattgcataaacaagaagattttaatacagataggcttaataaattatgtgaagaaacattaaatgggaagacagaataaattaactattaatataatggaaattttatattggttacactcttttttatctaaacagtaacattttttttattgaccctaataacctataatgttttctaaaaattcagtgaagttattaaaactttgtaaatctataaaatcttctcaaattttataaattaatatgttataaatcttttaaaattcaaactacaaagttttaatcataaaaatatttttacaaaatcttaaaattcactacattcatccaaagtcttgtaaaatccaaaaggtttattataccaaactaatattctaaaatcctaatttaatacctatgtagcaccgactccgacacgcgacacgtgacacgacacgactcgactctccgacacgtcaatcttaaaaaattattgatttcgacacgttgggacacattttaatattaaatcatatttttaatttatataatgtatatttcatttaatattcaataacttaacaaaaaaattaaactaaactaataatatcaaattattaggtattaaaaaaataaaaatagcacaaaaaaaggttacaagattcactggttcaatctcaaacatacgtcaaattaacaaattatcaagtattaaaaatataaaaaaagcacaagtcagatacaagattcagtttcaaacatacattaaattatcaagtattataaaaataaaaataacaatatatcaaagattcacagtgaaagaaatatatcaaagaaattaggggttcatagatagaattaaagaaattgggggttcaaataacacaagccatacacaaggtcacaagcaattaaaaaaatactgcagaatacataaatggtttttttaataaaaaaaacctaaaaagagaaaacctaaaaaatctaagctaatagcaattaaaacacaaccacatgtccacagtcaccttatctgtgtgaggcacgaacggcggagagaagagagggagagaaggagcgcgaacggcagaggaagagagggagagaaggagcgcaaacggcggaggaagagagggcgagaaggacgcgcgaacggcggagagaaggaggagcagcaccggtgacgcgaacggtggagagaaggaggcgcgaacaagaagggaacgagaaggaggcgcgaaaagggaacgagaagggaatgagaagagaggaacgagcagagcagtgtcggacacggtcaaattcgcgtgttggcgacggtcaacgagtcggagatgttgaccgcgtgtccgacaccatgtcggagcgtgtcggtgtgtgtcggcgtgtcgggtcgtgtccgacgcgattctgccggtgttttgccgtgtccgtgcttcatagtttaatacatctgcagtttttatgttgtatttcctcattttatttgtgttattaagtgattttgtttaaattaaactgaaataaatatatttgtatggtatagtatcatgttttttttaacattttttcttttagtattgagaaaattaattaaattaacaaatattatttatttatatttaaatgaacaatgaaaacaaaaaaaaaaaatattgatttcagattttaaaggaataaaactcatagaaaactaaaaatatattttaattgttaagaaaattatgaaagcgtggtttcgttttatctacgaaacaaagcggaaaaagtgaggcaacgacatatttggtgatgtcatgaggatgggtgatgatagaaacaaagattgaagcggaagtacattgttgtctcagccaggtagttactgttactgttatcatggaactcaaacaacaactgcttcttctgattctaacgcttctttttgctattgccacgcctgaatacgttcgatctcttcctcgtaaaaccttaaccatcccatgggattcaatttccaaggcccactcctcttaccctcaacaggtcaatcaaactctttttcattcatcatgttcatattcataaataaatagtactatatcatcacccactttgtgttatttatttcccacttgatcaactcacagtacctgatttctttcgtattttgattggattatgttgttcagttgggagggttcatttttttttttatagggtgatattttcaaaattattctctatttcaagttgttgactttaatttctacgtagaataaaaaaaatcatattgttaatcattcagaaatcgtctttgatatgatttttaagacagtgacgatgggagcatgtctccggggttcaagatatagccctgcacggtttctttggttatgaaattcaaagttgatccaataattttctgtcactcttgtattggatttatagttcatgatctgggttctagtcacaaatcttcaaaagacattttttattcgttatggttggtgatttcttatagtatatatctgtacagacaatgattattatttatcagctaatattatgtaacttgaacagtttgtttcgctttctatgaattatttgccaattctaggacaaatattctgtgaactgtcaaccgtgcttcctctattaagcaatcatatcagcctctttagttagtcttttatgcatgttcttttatggtgactattaaatttcagtttctttgataccaaatttttgttccaggtacacatttctttggcaggagacaagcacatgagagttacatggataaccgatgataaacattcaccttcatatgtagaatacggaacattgcctgggagatatgactcaatagctgaaggagagtacacttcttataactatctgttatacagctcgggaaagatacaccatgccgtaattggccctttggaagacaatactgtgtacttctaccgatgtggtggaaaaggtcccgagtttgagctcaaaactcctccagctcaatttccaattacttttgctgtggctggggatctgggtcaaactggttggactaaatcaacactggcacacatagaccaatgtaaatatgatgtctacctgctaccaggagacctttcatatgctgattgtatgcagcatctgtgggacaattttgggaaacttgtggagccgcttgcgagtacaaggccgtggatggtgacagagggaaaccatgaagaggagaacatactattcttaacggatgagtttgtgtcctataattccagatggaaaatgccatctgaggaaagtggatcaacttcaaatctctattattcatttgaagttgcaggtgttcacgttatcatgcttggctcctatgcagattatgatgtgtactctgaacaatacagatggctaaaggttagttgatctcacctattgatcaagagttactaaaaattggataagtgtaatccaatccatgaccatggaaaactacacaatcatgcttgttattattatttttatttgtcttttttacactactctatcattttaaaaagaaaagtactttggagtttggaccactttttttttcactctttaatttttactcatccctcatctacaggaagatctgtcaaaggtagataggaaaaggacaccttggctgcttgtgttatttcatgtgccatggtataatagtaacaaggctcatcaaggtgcaggggatgatatgatggcagcgatggagccattgctttatgctgccagtgttgatttagttatcgctggtcatgttcacgcttatgaacgttcagtatgtctttatgttttagcattttattttctctgtaagcaccatttagtagaaactgggttttaatactctatctcattgtcagaaacgtgtgtataatggaagattggatccctgtggtgctgtccatataactattggtgatggaggaaacagagaaggcttagctcataagtaagtttcacagccagaaacatcccacagaaatctgttttctgaatcctttattatgtgaaaaaaaaaaaaaaaaaaagctatattgaggtttatcatgtatgcagcctgaaatttgtttttccgtcattgttgctgcatgtatccttacataattgtttgttgacaggtatataaacccacagccaaagtggtcagaattccgtgaagccagttttggtcatggtgagctgaagattgtaaactccactcatgccttctggagttggcataggaatgatgatgatgaaccagtaaaagctgatgatatctggataacctctttggtcagttcaggatgcgttgatcagaagacacatgaactcagaattttgacgccctaaactcagaactacgtggattagcaaaagttatgtaaatattgatgattagacaagtccttagtttagtttgtatcactactagcagcagagtgagtaaactgaggtataaggctagttgtcactttgcaagtgatggtgttgcttgttttgtctgaacttataagattggtttctgatttctatatagaaaactaaaacttagcgtacttaataaccagcaataaacatgtatgttttatattcttgactgacattgagattttagattatgattctagagtcatgcaacgagtaaagccgtgaagattactgggattcacgaaggtctaattaacaaaatgccttaaatctgaaatcattgttcgctgataccagggaaatgggatatgatagaatgtaaatcagcaatctaagaatagaacggtaaaaacagcagagtggataattaagcattaagtggaaactactgggttggcctattctgtcttgaagtactgaaactgatttatccaatatacatcaacacatgaaatctgctaaatagaatctaattacatttatgccatcacagtgattttataaagtgtgaatacaaactgagttctaaacaaatatctgtatctggtgaatttaggcaggtaacatctttccccttcctcctctcttttaggttttgtttctccatgttgttttgttaacaattaactctatttcacatcatcatcatcatcatcatcaagtggttagaaaatgggtaactttggcactgtcagtttctgctgaggtttctgtaatcattaatggtccagcttggtgcttgcaacgtctcttggcttgaagttgaaatcagcaagcatgagcagccatgattctgtccaaaagttctcggggaacatgctctcccctactttcttgaggagagactctagcaatatgcaatccacataatgtcttccattcagtgtaaacatgtaggtcaggtcatatagcagtagtaacactacaaactgcaaaattgtcttgattctaaagacatcattcagtgcattgtccaatcttaaaaatataattgtgctaaaacatcgatacaaattcccaccctcttagcatagttcaatttcaaccagtaactgattgctttatctcagactgctcctgtccttgttcagcagatgtggcacagcaataatctgttaagtttcaataaactcattggagtggagttctccatgcatatcattatacagataatccactgggattcccatgttgtgttttgcatgcagggaaaggatatggaggcaaaaaaaactcttacaagtttcatggttcataacttattgccaatagattctattttgggttgaagcaacttcttcgagttgttcaatcaaaagaagaaaggacctcaacaggaaaagtgtttgctcagtctctcctctttacagcgtctctgatctccaaccatggactcaaaagtatccaagagaccatccaaaccctcatgattcaactccccaactgccttcaaggcaaatacaatgctttcaatggtggacaaataaccagctttaggctgatgtctcacatcactatataagcttgtctcattcacttccaacttcacgtgtggcaaaatgttcaaccaaggattttcactataaattctttttgccttagcccatgttccatccagaacaatcaagttcttcacctcaaaacctatagcatccaggttactaacatcaacagccttatcagagggaaatagtagtaccgatccaggacgaacctcaagctcaaattcatcacattcttccaatttttcatccctattcagttgcttcctctgaaacttcttcaccaaaaaccctgttgagagtgcttcacaagcttcagggtacgccaaaatattgtcaaagcttaacttgggggattgacattgtgcttgagtcatccaaatatgagacaaagagctaatggcaccatatttgccaatggtaacagtaacagctagctttccattctcttcatgtacacctctagctaaatcacactttagactaattgcatttttctcaacttcatcgttcaccacttcaccatcactgatactcacttgtttcacaacttctacattagaagcagaatccagaacatctccaacatcatttctcaaaccacattttccagcactatcggtatcaatcaagttagaatctatctcagaaagcaatttctgggtgtctccaatttcccaacactggcgagaaaacaatgcagttggctcgtttccagcatgaccggaatgggaattcggatccaacaaccgaattaggaaccgggcttcgaaattaacatcagaaacagttgcaacggtgagattcttgaggcccaatatagcgattctggtagaattgaggggatgcttacgctctagcgcgtgctgtaggatggttacatgcacagaattttggagacccggtgtgaggattcgagagcagagacacgttcggctgggtttggaacaagaagggcaaatgggtcttttagattggccctgttgcattgtcgacatcgaaatctccagggctctccgctgaaagagcttgtggctgtgtgaagggttgaacctgaaccaggtgatgctccggattcgggtaccaagaaaagccaccattattagcttgggctgctaccaaaaccctaaaacggtttgaatagggattttttttttttttttttttttttatgaattttaaaggataaacaatatttttaattcctaaacttttttcaactcttatagtttttatcttcaatatttcggaaacgggtcttggatcttggttcccagactttttttcctttaatattttggtcctttctttgtttccaaaagagtttaatgttgtaagtgatgacgtgatattttttattacttttttttgttaaaaattgtaaaaaattgtttggataaatttttttatctttttattaatatttattaatgatgattaatttttattaaaaaatttatctaatcatttttaatgaatttttttatcccagtcaaatattattcatcaacatgactcaaattaaatactttatttaaaaggattgaatttggtatcacttatatcaatgatttaataatttatttgaaaaattttaaatatattgtaacgacttttaagtgttataaattgttataatttgtttgaaacataattaaatgaaaatttaaaaatataaaaatgtgagttttttaacttttttttttgttgctaaagtaggttttaaaaaaattacttatataatataaatagagttatgttcaaaactatttatataacatgaattgtttttgccatgcaggatgtgttttcttgagtaacgatcaatatatttttttacattaattatatttagaatcgatgaaatttgtttttttaaatgttgtaaatataaaaaagtgtataaccaaaactagaaaacgatgcctcttatatgctaaaaaataaaaaattaacacaaagtaccatttggataacactttatcctaagtgacaacccgtaacatataagtaattttaaaactactctatttagtttgtttttcttaaaacctatttcctaaaaaaaatttctcgagaaaatttacatgtgagtatcttaaaaatgatgacattttgggatcactataaatgattttatatatttcatgatattcaaattgagtttcttaggtatcttggattagtgatgcccttagaccaaataggtgtcattgtaatttattaagatttaataaaaaataaactccttttataaaatgaattttcttaaaaaaaaatataacataacagtttaaaaaaatgagacggtagattgtgggaatgattcttaaggagcaggtggagggtttcgtggggtgttaatatttgacttgtgcattccacacgctcccatcgtcacttcccagttccaatctttcttccgattgaaggcatctaaggagagaaaaatgcacgatttctgcttcacgattccgtacggattgatgctagtgggtggtggactgttcgcctacataagcaaagggagcatcgcttctctcgccggaggcgccggctccggtttgcttctcatcatcgccggctatctcagtctcaatgccttcggcaaacgaaaaaactcttacctcgctctctttctagagaccggtatcctataatttctttcctttcattattattattattattattattattattattattttgggtgtgattgttgacctggctctcgatgattctggatctgaaacgtgttctatgctagaatttgttatttgatggaaagatgtggatatttattggattcattttttcggattgtatgaaattctggatttggattctctctcttaggatgtcatggtgatatttagattagtaattccatgttctcctaaaataatgcagctcaagtatcgacttatgaaaactttaagatgcatatgttgttttaacttgtgggagaagtctgatctattttattttaccctctggatttgcgttaggtgtttgttgaaatgtttatcgaaactctgcctaaatgctctttgggtttcaaagatattgaatgatggtgctttttcatttactactttctattgaaaggaaggggatttgttaggttaggttaggataggttaatagggtgtctacctgatggagggaaagtgatacatagatctgaaagagggtgtctgtgcacaatattgaatgccaaggaagcatcaatgaatgtatgtaacctgatcaagatatattgggtgcatggttttcaaatttccattgcttatttatcagacttggatcttgccccatacacttttgtcattagtatagttgatgaagtggaacatggtttgtcctacaagactataactagagctttttgctttagcttcgaatataagcccatgttttagaatataatgataaatataaaagatcaaaggagggggatgtgtttgtaacaaatattattcgattgaaagtaaaatttcttgacagaatttttttgatttaaaatgcttatgaatataacaagtttattatcattaagttaatgacttgcattgctcctacttagtaataaaaagtatgcacagaaactctagcaggggtatagatgtatcacattgcattatcatatgtcaaaactcaaaattaagcaagaatattttagtaagtcataagttatactaaattactaccaatatatataggatcaatgagtatctctgtgtttatactgggaatgtatgtctgttactctgtattcatttgataagctatgatattaagggggtcttgctctggttgagcaagggtgcatgagttgttgtaaactccctgacattgtcttcgatttctatggataaaaaaaaaaaatctgataagccatgatcactgagttaattatggtccatattagccggagtaattttctatgcttttttttttctaatttgtatactgtgaaacagcttgtgcagccatactaacttgggtcatggggcagcgatatttggaaacatccaagattatgcctgctggtcttgttgctggaatcaggtaatcaaaggattgattagaagtacccaaactcgttgtaaacatagttttacttttactctcagagttgtaagaactaaatttaaacttttaagttttaattgttggataagttgttagtttgtagattataaatccttgaacttgtctttcttaaaagtaaatgcatccatgaaagttctttaaactctttttaaaagatcaaggcttcaccattcccatttattttgagaataaaagaaatatttttatgtgccattatcctgaacttgttttctgctagttctaaaatttgtttttaacttcccattactgatttgaagatctatatattatgttctgaatttgaagtcaggaatcaagcactggcagccattacttagtttatgttttgtgagtttgtccaattgctccacatcagtcacctgtagtttgtatatggagttaagatatttgtctgtctttttcttgcagtgctctcatgactctgttttatctctacaaattagcgactggcggcaaccatctccccaccaaggctgagtgatgatataatgatatatcatatatttgcttactataatacagatatgttggttgatctgcatgccttagatggttaagatatatcattgtactttagtgatttcaaagtatggaacaatgttgtgttgtcgttgtctttatacacgtaggagaattgggccagtacttcatcactctctaagcagctctttttattttctactttcctttttctcttagcttagcacaccttatcactgaggttgcttaaattcaaaactggctcttatttgttgcatactcgacaaactcgatggaaattccaattgaaatttatcaagcctttttatttgactggtcaacaaatttacatttcttggtgtgagtctactttaaatatggaataaattacattgtcaacaactagatcaggttctaacgcgtgcctcccaggaattaaatttttgcttattgcattagctaatacttgttgtgcttatctaaccatgaaattaaacttgtgatgaaaattctttaaaatataatttgtaaaatcatttttgaaaattgtgttttgaaaaaaagaagggagataaagtttatttggtgaggctgttttaaaacagattttaaagttagaaaacaaaataagaattaaataaaaaagttaagttttattgataaaaaacacattatcaaacatttatttattttcaaaattagaaactgttttaaaaggattatcaaataagtcctaagtttaaaaaataaaaagaaagaaaatagtgtctctccccctttcttcctaccgaattagccaatttcctctcattttcttcatctttccatgtttttcattgttgctttgattttgattctttctaagttccctttaaaattctaaaaaatcttttgagctccatatattttgttcccaacccacataactttgagaagttttttttttttttagttaaggatagcgtcctaagaagtaaaataagctagttattgctcaaaaatgaaaatactacatgagctctttgcggtatatccacaattcaaatttgagaaaaatagttttgatatgttttcaaatccaggaaaaatatatttatagctttgagtaccaagctaaattttatttataaacatattgttaaaacatcttcaatagtaacgtgggttaaaatagatctcacaagttagcactttttgtatttttttaaatgggtctaattagtcatctcttaattatttttaatggttaataactgatttttttatacataaaacggaatgagctcatattattgatgatgaaagaccgtataaaataaggaatatgattataatcatgggaactaacattaacagtagttacccttgcaagcaaatggacaactacattaacttgtctaataaccaattcaactttgaattgaggaaattggtccataagttgcttacagctttggatgataaaggctacttctgtttatattcgttaaaaaaaaaaaaaaaaagactgattcttatatacgaatgattctcacatattgcatccacttcatcctcatccaatggtgaactcagttaagaacaattcttaacttcaagaacacacctatcctgtcaaaaaaaaaaaaaaaaaaagaagaaacaacccacctaaaattaccgctggagatgctattaaagccttggtgaatagttgtgcctcatattcaataggaattatctccgttatgattctagactagttggcaagttcttcacgatcgtagaagctcgagaaatctagaaaagttctggacttgatgcccttctactaaaattaaactttagcaaataccctcgagtgtatcccatgtaacgccaaaaatatatttaatcttaatatgtctacatggattgtttttatttaataacagcttatttatttaataattagccaacggtgaagatttgcttctcttggcattggcgccatttgataagaaagtagccgttagacagagagaggaggaaagaggatttggcgcgcgctaatgccaaaccctatataaaggaaacaacagaacagagacacacactctgcatctgcatcagtgggtgaagaaagaaagaaagaaagaaagaaaggagaaaagttgaattggaactgttagaagagaacgatgttaggagggaacagcagcagtgagcttcaagatcatcatagggaggcactcgtctcgtcggagggtccttctctatccacgtctccatcggatcaagggaataacactctcactccgtttcttcacagcacctccattccggtgttgccagccgaggttgaatttccaagctctcagatcaatcatcactcgcggcctcctccacggaagtcccgtgagcacaggagatggactgaagaagaacacctgtactgtttgtctctctctcagtgttttctttcttaatattgctgtttcattgtttttctctcatgattcaaatctttataccaatatgtaggttgtttctccacggacttgagttatatgaaaagggagattggaaaaacatttcaagaaaggttgtcaagacaagaactcctactcaggtggctagccatgcccaaaagtattttcttcgtcaggcctccgataatagaggtcaaagaagaagtattaatgacattaccttacaagaccccgtccctcaccgcattgaccaccagaatttggttgcatcattcagtccctcacaacatcaatcagcgacattaggttccacgcagtgcaacactgaatcaaaattagcatgattgtttatattgatatctgttcatttacattgtttaaaattgttgaatacatagttagtcatgtttgaaattgttcaagaaaagttaggattaataataattgtggaaatttctgtagccgcagagttgatgtttcatctttgtgtttgaacgaaaatatatagcacaattttgattagtcttccttaaattgcttcctgttgtatgtgtttcatattctttgactttcataaagcgtgtataatatggtgatgatgtataatatggcattgtagacccattgtttgtcaaaagtatgacatccctgaacatctggtgatgatgttgatgtaagagaggtcgatttctcaatccatgatgagcctttgcttgccatgcaatctcccgaaacacaatctgataacaccagccaaagtttggaagacatggcagtccattgtctgagatatttttattttagttttatttatttggtgtatgttgtcttcatgtgtatcagatttacctgatattgagtaagctttaatttctattttgtagagagaaagtgaaagagggagagagatagagatagaggggtatatgagtaaactttaattgggtactttataatgtataactactcctacctaatatttatattactaggttaagtacatacaagcacataggtcaagaccgtatacagactaaaactttactcttagcactcccactcaaacgggagtataaatgtttttcatgcccaactcgtaacaaattaaatttctatgcacttcattaaaagcttttgcaaatacatatgctagttggtcatctgtcttgacataattaagaggtagatacaagatttatgttggaccttatctcagatgaagggacaatctaccttaatatgctttgttcttttgtgaaagactagatttgatgtgatgatatgaatgacaacttggttgtgatcaccccgcagtttcataggacaagtattagcaagttccatctcctacagaattggtctcacgcatatcaactcatcagtcataaccactagtactgttagtattttaggaataagataattggattgattgtttaatggctgttgacgttggctttagagaggttagtaataattgacttagtcaagggaattgtatagaagtgtaatagtgaataattggccgtgtagctctcaacaatagtggaggagcttgtgttgatctctcaaaaaagcacactacaacagagtgcagattccatatttacaggcaacacttcactgactacatatgtgggtggattattaaataatattatacattattctagcattttcctaacttaagaactatcgagacatttctattatctatgtgactactatagctttatagaaaaatctagaattatcaagacacttctatagctttctttatatatacacacacatatatatcaattataaccattgacttcaaatatgcatgcctaagtaatgatggccctaaacacagtcaaagtgggcgaccacccaggacctcatatatagagaggcactcttcttcttaatttttaggtttaaattcctgcaatttagcattttttttcatttttgtctttgaaaaaaataatatattccagttcttgcaaaatgtgtgttttttcttcctcaaagtgttttagataacactttttttactatttaaaatatattttttactattcaaagtgatatataaagtattttaagaacgaaaattaaaaataaaattgcaagaactaaaatgaaacaaaaattgtacgagtgaaagcaaaaaaaaatattaaattatagggatgaaaaaaatatttaaacctaatatttgttattaactataccctttatacccataacattgttacataaccattattccaaaatgtattttctagaataatattttgttttaaacatctaagaaagtactttccgaaatgttaagtattaatttgtattttgaaaagtatttttcgtactgttatgagtttcataaaatactttacaaaatgttaaaaaaaaatggaaaaattcaagcagaacagtaggagtctaggaccattaaaaaccctatacaaaggaaaaattatacaatattgaagcaattcaagtgaaaaaacatataattggtaagggtccttcaatttagacaactctaaaagatgtttggctgcaacaacttagatatacgttgatgcatatataaaatgatagacattaatagtgttgtgagagagaaaaaataaagcaagaaagaaaagtagttgagagcataaacatactacattagattagagtataaaaatcctaatgctaaagcaagaggtcgagcaagagatcaaatggggatgaagaaagtaaagagaagaggaagcgaaatgaaaaagatggaaatgtgtgcaaaacagtgcacatgaatggccatgcaagattaattctcttgcaccgaccataaaataaaacaaataaaaaattagaaaacttacctttgtttaatgttccgagttacatggttataccggatttgaaaagtgatatatctgtattgcgctgcgttaatctatctgcaaatgtctatgttctttaaatggtaaaagcaggtaacacttacattagagtgctgaattggagtaaacactaaacaacgaaattgctactttcacaactcagtacagtttttgaagttctcaattcaaagctgccaaacccattttagagagagagagagaaaaaatgcagatgcaagacttacaaaatattttacatagcacttattaaagttaattttgcatgatgtacatatattcaagtcccttatatttacactgttgaatctggctacatagataatccgaattacatgaatgtctaatataagttcaagtttgtaataataaatacatacacgatatcgaattgtttgaatttctttttacattaaatggatacaaacaataattcatgtggcatctcctaagcaatccaaagctagaagaccaaaaactctggtcacacgcaatcagcccttcgattggaggaaaaaattgaagactgctagcaattctggggtctggagtactttggaggaagagatggacacttttcattcatatgagggtatggttgcatggtgttgtatccaggtaattccattctatacttgcctttaatttgacaataaggaagcttcaccgtgtctccatcattgcaccattttggcaagcgactagaattgttctcaaaaaaattgagaatgtaagcatcttttatctgcacttattgcacaaaaataagtctatatgcgccaggtcaatatactactgtaaagtgtttttgacttctagaaacacaaacaatatatgtagtgaactgatatcaatcctgctcaacaacctgatttcactttgtaaaggattttgttagaaatctatacaaccatgataagaaattatatatgctcaatcatttgtataaattgtgtaggatgaaattcaaaagttactataatattgcaagcaattcaaaagaccaaacttcccagcaaactcaccgtaaactctgtcacttgaacggaactagaaattggatcaaatagcccagcctccttgtacatctcaagtatataagcaatgcacgaagtcgacttcccatcactgtaggtccaataatcttgttcaggaatcgtcagtagttcatcaaaagatgatccacgcttttcaacttctactaaaacttctggaaggtcaagtccctgtagaaacacaaaagggccacatggttcactttttttcactaatgtggaattctatattgctgattgcttactaatctatgcaatatatcacatcacaagcatcttatgacttatgctagacaattgaagacattgattcaatttactagcataagcaaaaatgtttagtatcacatatgtatgtgtgtttgtgtgtgtagacatccattcaccaacttgtgttgtctcacattgatgacattgttatacatttgtaacatgtgaattattcgcgtagctgtgcgtattatttaaattcctagtttccacatttaggagatttcagcattaattataatacattttctgatcaagaaataaaattattatttctcctttttcaagtgtgtgtgtgtgtgtattggagcaagaaacaagattgcagcatactttagttccaagtcgtttgttcaaggcttcattccacatatttgctgcatattcaggttgaagttgactccaaattgtcataacgcaagcaacctgcagagaaacaaaagtaaatgctcattcataaaacattaagctatgtagcatgtggctaaaccaaaaaaagacagaaagggcagaagatagagaaaacaaacaatcaataattgataccacattcatcactttttttttttttatgtgaaataacattttcttcaatagcaatggtctttctggatggcagacggataactatacataaaccagcatatggtacggtaattcaagcaaaactttatactattcaagcaacttaagtagaaagctcattgagttcttgcaagatcaaagccatggtttatataattctctgtttgaaatatttcatacaattgctagaaaattgtaggtaaaaaatgctaaagcatggcataatagtgcaaaaactcaagatagttgaatctaatgaaacagatgaattgaaatttaagcagaacaactgattaaattaataccacattagcatccaaggggggtggatagtttccatttaaagtgtctatccaactgaatatcatgttatggtaaccatatggttttcctgccatgctcagtgcatactcccatgcagcagtctcattaaacctggcacgcaaatcagggtgcaatggaagcagagcaatatggggattggaatcatcttcattcagttcaaagtcccaccactcttcccatggtatcacagctattatatcttctccctgcaaacaaaaggtgaggcaggaaataaaatgctagcaacttaactccaaatgccgctgcggagttgacaaaccaatatggactatacttttaccatcattgctcaaacaatcaaacaaccatcatgaattatgtcataaaagaaaatctatatatgttaacttggtaatcaccatgcactaattttttatcacaatttcaaactgaaactgagagcataatcttgctattctgatgacgacatggtaacttaaggaacttaaaacaattcttcataaattatatcaaaacctaaacatcgcataggattcaagaaatgttaattttcttaaggaagaaaatataaatattaatgaaattataaaaaaaattgactatgaaacatggtagtgaaattgagattcaaattgtgaaccggaaggcctattttccagatagcaaattgaactgtatgattaatcataaaacataacatatacaactaaaaaagacataaaagcacaaattcattaaaaaaacataaacataggagcattttaacataaggaaacatattaaaagttaaaacatacacgtgtgttggtgggggggggggggggggggggtagtgttagcattttgaagtcaaattgcttacaaagtgacataagcttcaaaacaaaaaaaaaaaaaatcaccaattcttaacagccatatggacaaaaaaccagtagctgctcaaactcagcagtatgagtgtatgaccaccctaaataagagtggaccacaaagcttgcatgtagggtagattgggaaaggtaaagaagagtagaagacaagaagaatgagtagaaaacatgaaaaggagacaatgggctgccatgcggttgattagagggaaagaattggccaattccctctctttttcactaatttttcaggtaaagaaaaacaattttagggttcttcaaagttcaaaactgggtcctgcataacccgaaccactttggtgtgcggtcgcttgcaccaaaatcacatgattcatgtgcaatctacaattcctatgtgattcctgctattcatggggtgattcaagcacaaaatgtttcactcaaggaattgagtcaccaactgctcaaatcgaatcgtatgcctttgtatcgtgaaacatatgatactgacaacggtgctatgaaatataataaatcttgcacagaaccaatagatataatgcaacttaaatattttaccttttcattttcatgtcctgactctccaacccaaagcttcccattggagtcccttaggcaaacagcagtgtgaccagcataagctccactaacccacttctctagagtctcaaaagcaccccaccgacctcgaattttcgaaacggcaaggaaatctccagaatgaatgtcatcagcactgacatttgtaacaaaaggctgagggcgcacttcaaaagaagctcccatatgcttctctaaaaatttaatattggagttctccccccatccagtatttgtaaatagaggcaatacctcccaaagtgcttgaagggtccccaacatcccagcttgcaagaggaaaattgataacccatggttttttacctgattgcaaagaggataaggatctccaaaacaaaaatgtgtgtttcaagtttcaaaaaactctacttagtgacagtgtacagaagaaagatggtcacttacatactcatactcagctttcccttcccactctttgaactcaagcgtatgctcccgggccaggaaataataatcccatgttacacgataaggggtggcaaaaatataaagatccatgcacgtccaactgtgagcattgctaacctagatcagcacatagataattatcaatcagtttccgttgaatcccaaatccatacatagagagagagggggggggggggggataaaaagaatacaattatagaactgcatagactaataggaaaatactaaacatacacccaacttttcttccatctcacttctatgatctatcccatttttcttcctatttctcttttcattttccatcacatcatttgccacatctatcagttcctctctatttatttattctctttatctctcttatttccatccatacaccatatttggggagtaagagtttcattactctaatgacatacaaaatactgagcgacattaaatccacttaacttagtctcctctaataatttaatacgctttcaaatgacaacacgtccaaccaaaatccaccaaattacaactcaaccacataacataatctatgcattccaatattaaaaaaacactctttaaatcttaatgacacctactccctaagcaatttttttaaagtaaaaaaaaaaaaaaaactacgaaatatttcaagagtatgaccaatttttgttaaccactcagaatgaagatttcatgaaacgaagttgacctagtccttcaccgattagtattaaataaaagttcattacaacaagaatgacttatcataaaatttgatttttttttttttcaacaaaaagaagtgacatagatttccattcccacacttgagaaggaagcgaccttgatgtgaagggttccaccgccatattgagagccgctcttgttgtgaaacaccatccaggctttgttctcgtagaagcaggcgcctttccacttgagactgtcgtccggcgaagaggcggcgccgacgaagacggggaggagatccaccgctctgtggaggcggttgaggatgggccacgacacctgtctgggcagcagaggaagcacgtctcgcgggtgaaacggcgatttcagggcccaaacttgagaacccgttacgcagactgataccaggaggagcagcagaagccacgctatcttcatcttcgccgtggcacgagcacgatcgaagaaaggagaagaaactcttttgaatgttttttgagagtcaactatgcatactttgctcctccctctattttgtttggcatacaaattattggaattttttcgtgtttatcttaattaaaattaaaggtgaatttaactagttgattgaataaaaatgtatgatttgttatcatcttcttataaaataaaataaaaattttaaatttataaaaataaataaataaatataattttttttacaaaatattattactaatagtaaaattttacattgtcatttatcaggggccctaatcaagattaattaactaaggggatgttgattttttaactaaaaatctgaatttcaagttctctatgaaaaattatatcaaatacttaaaatgataatttttaattgcctatatataaaagtgtatatctattaaatttaagttgtaatattttttttaaaagaaagagagatatatatgtcattttattcataataagaaaataaatataattgagtatatgatcaaagatataaacactagcatataatttatatgctcttattaactagtgaataacttgattagttagtcttttaaaaatctcaccaaaaaattaaaataaataagatctatatttagacaaaaacgtgtggaaatctgaaaatattaataatctaagagcattgttggatacaaaagatatattttgagctcccataccataaagtcgtatcaatgctttgtaagagagcccatgcttttgctccacgagggttaggaattccaccttgataaaatgaccatgtttatctcaaagataaataacaaccccataatagttatgctccttcaagatgacatcattttcatatacgttgttgcatttgagacgaccagttgttggtgcttcccatgatagattaattcaaattaaggaggctgaggttgcatgttgatgtcctttgtgattcttcacgcatgcttcaattccattcagaaaagtgttgcaatgccataaaaactgataatatttatttgtggctgaagctcaatattattccatattttctcattttgcctttttcaaatgcaccataaaataacaagaaaattgcttttaacatctagagatgccaggagattgaatattaactcataaattccttcaatgctctcactttgtttttaataactcgtcataatccaactgactcccatactttctcaactttaattgaggacacctgaaaagaaaatggatcagtcattcaatattataagttataatattaatatttaattaaaatatattaataatataaaagttcttatactaccgtttatatataaattaacgtacgtgtataataactttattgaatattataattactgtaaaactcatatttataatatttttaattaattaataatatagaaattttctgttcaatttttgtacagtgtgagtataaaaaggtttacagtgttaattgattagaaatgtaataagtatattttaaagtaattattgttaaaatcaacaaatttatagtacatgcattaaaaaaaattaatattgtataataacttatgattgattaattatataaaaattctttaagcaaatagtgtatacttactcaaatttgtatactattaaaataaaaattaaaattatgtaaacatacgaagatattaaaattttgaggttaaatatcaagtcttgcagttgcagacgtatgaaaaaaataagttatattaaaaataaaaaaagacagatattttgttggttcggatgagatgagaagactgtgataatcataggtgaggtggtgattggtgaattgaaaggtgtccatgtgttcaaataatgtaatactacataactacaaccccaaaagatcatgttactacaaaaaagatggttgaaataatataatgtgtgatgatacttatccaacacgtgtttaaactataaaaatgatgctaattacacagcagagttgtttaattaaaaaaaaggtcgatgtaatcaatggctgtcgtaattaaccaattgtttgatctctcaacaggcatcatatataccgtatataaatgtcgcattaccacatggttagctttcgatctcatatgtttgtttttctatgaaaataatggtgaaatatattttattcgagttagtaatatctggccaaacatgtgtgtttctttcttactagtcgtgttggaatttttaaaaggggttcatacttattttgtttcatttatattttcaaatagattaaatattcgattgacacgataaagataaaaaatatactttaaattaagatagagactaagaattatgaaactcatataggacctacattattatttttaatatctcaaccaaatataacataaatgccaaaattaagtcatcgatcctagtaaatttataatgtttgtaagataaaatagtagcttaatctcaatatattcataacactaattatttttttatcagtgtgcaaataataaaattattatttttatacattttttatatttaaactacaactagatagatttccataaattacaaataatgctcaacacaactacttgtttaacataattttttttagctaaatactcatttttgtctcaatatgtaaaacataaataaattcattcttaaaagatacaaatttaaattttatcctcaaaagtgaaaaaaaatgtaacacatgtgtttttatttgaatctcatatttgggataaggtattctcagattagaaattttaaatcaacaaataaattataaattatgtttattattatgtttgttttaacttatatttgttttccttttttttaaagtatttattgtattattatgcttgcaataataaaaaaaagagaaaagatgaaaattaaattatatttttatccttaaatgaaacaaaatttagtatataataaattagtccaataaaaatttaatgacattttggttcaataaaaatttactaacattttagtcaaatctatatattgacaatcatttttatgacattttcgttcttatatgacacaaactttttcgccaataatgaatgaaagttaacagattgatgaatttgttgtacttctttcattttcaaaaaataaaatttgaaattttattttttggagataaatttgtaagtactctgtacatataaaaaatgattatttatcctaatttttttaactataaatagaatattagggatttattggaagcttcaggtttggtatattccctttataccattaatatatcttataataatgttatttttatctatctgtttatcgaattctgctcccactgttggctaatcgtgcaaggaacatatttacttagcaacaatgtcgtgacaagtttggcaagtagacggaaaatctaaaaagtttggaaaaccacgccatccaataaatttcaaacaaaacaaatcgtgggcgtcaaagttgcaattgttttggtgaattggtgaccgtagcagattgctctgtgacgttgcacaaaaacttcaatcaaacaaagaatacagtactctgcacaatatattatagaagtaataaaatatatactaataatttctaaaatcagagtggcgcagcggaagcgtggtgggcccataacccacaggtccctggatcgaaaccaggctctgatataaaagagaaaagcttcctatactttttttaatttgcagatatactcttatttatttcaaatcaaacaaatacattcttcctattaatttcaaacgaataacatttattcacaatacatatcttatcaattaacttcatccccttttcttttacctttttcatatttcataattaaaatataagttttctttacatttcaaaaaaattgcatattcttttaccaattaaattttaataatcttcctttttgtgtatggcatcgccactacctttggcagcatccactaattaattacattttccaaatgcaaattattgctcttattatgacatttgttaaggaaaaaaaaagaaaagaaatgtacttattatatttagaacaatttttgtttaattcttatttttatgaaataaaaaatattcagagtgggtctaataagacatttcaatttgtctataatttattttaatatcttataaacttatttatccaaaattaaaacgttttgcataaaaacaaggacttgaaaactttatgtaacgaaaaagtgaccgaagatctaaatgtattaattaaaaaaactaaattcaagtaaaaaattgtttgtaaaaaaatacatattaattataataaagaaataaaatgctgttaagcaaaaataaaaatgatgtcatactaaaaataacatttctctttaaatttcaatgtaaaagtgaattgtgcaatctttgtttgttttttaaaattttgaagagaccaatattccaacctttagcgtatggccttcgagccttgtttatgttagaaaagccacctacacaagcaattagtatatttggataaacaatttaatttattaattgcttattattttttattatgtaagagattttgtctaaattttaccataaaacttattttcataaacttcgtcaagaaagtttatttttttattataaaaaagtagttaaaatatttcttttctttactatcccaaattcatttttttctagcatccaattgaattggaatatgaaatatcataataatgataaaaacatgatgtattttttttttatattccttaaaatgaaacaaaatcttgaaatacaggttgaatttttcaattcatttcaaaaattaaattctatctatttgttttgttgtaataagcatttgtggattgaatgcaaaaattattatgagttaaattataaaaaaacaaattaaaaatgaatattcgtgaacagtataaataccaaaaaaaataatgattattttcttgatatactgagatctatttaataagttgacctctttaacatatatttttaaatacatataaattatggataaaagatcgaattcaaattcttaaccacgtgcaggtacttatgaaacaaaattatataccaactatgtgatactatgttggtgtcaagaaagttattaaaagaatttgcaattgtagtggaagactacattagagtatcaactgctctctctattttgctgggttgctcagctggtagcctcctctatatggtttggcttgtgtcagaatgatggcattttggtttttctttcatttggttaacagatcacatttatttcaatgcttatttttaaattttctctttattatgttcacccctttgttggaaatatttcttttcacttatcttttaaataaggagtttgaaatataatactcagtcctcgccaatatgtatgcacttttactttttaaacatgttcaaatatagtacttggtttttttaataaacaattcacacaagatagtaccctcttcaacgcttccccagtgattctttgatattcagtgcgccctaaatctttcaaaaagccatgttcaggttcgacaccaagctgttttctagagagaaaaaaattgcacattcaacatatctggttcatctatccatttttccaaagctagcttgctttctggtttccttgtcaattgtcaattactgcatggaactctcttaccatcacagggtactatacatatgactcggcaacagaaacataatataattagttgtctctacattagtcaccctatccattataacttctgaggcagcatcctttggtatatatcacatatctgaaattaatattgctgcatacttggaattatccaagctaaatccgcacaccttacctaactttttttgtcaccaacacatgcaatcaacacatttggtttcttatgcatttttccaaagcttgctttctggtttacttgtcaatcactgcatgaaactctcttaccatcacagggtatggatatggcccagcaacagaatccataatataatgagttgtctctaaattagtcatcctatcccttttaacttctcagatagcatcctttagtgcatgcagtagttccatgaaggtcttaatacattcaacacatagcaaactaggtttggactttgtacgcactgtcacatcctaaataagaaaacacatttagaagaaagaccggattagaagaactaacatttcaaatggtcactattgcaagtttgcaacagcagcgtattcgccaaagagtcccacatcagttagtcaagaaagcagcagaacatgtaacagaaataaaagcaacaacaatatactaaccaaagcatgcctttctcggccttttgacagtgtagtatctgttcttatcggtttaagtattcaagtgtcgcctatttcttgcaatacagtataggcctggcacaccctaccaaattgtttaatttatggttatattgtttgtgctatctgcttgtacgatcgaaccattagaaatgattcactataaaacctattggctattagagaaaaagcttggttcttgtaatacgttttgttaaaattgtgttattgaataatatttgattggattagtattatgttgtgtacattttattttattgttttatacttaaataaatggatatatattatccctaggcacatgcattgaattatatgatacaaaggagttagtgttttcttggcagaaagtttattgaactttggtgttttatgcagattcactgaagaaattaggcacatttaatagttaaattagtactttttttttttctctttcccttttacttactacttaggtatgtagctatctaaatcacttgatattggcctgcatagccttgtgtgatacagatgctactgaaaatcagtttaccataacaaaagtagtcatctgtaatctacaatttagattttattcggtaaaattaatatacaagtgagcattatatccaatgtaagataaaaagattagagtttatcagaaggaaaatccaagtgccaatcttattaaaacctagctaataatgtcttaacctcattgtaaaacaattaaatctaagagaagtcaagtccctagctgaatgccctggcagagatttagaaggtatacatgactaattggagccatttcttctaattccatgtgagtatagtcgtctcacagtcatagcaaattgaaatccttttagttggggttataattggattccttgtgtcattattagatgttacttttgaaggcttataataactttaaatttacttagcattgcacttttcagaagtattgtcgttccagttcatattcctaaaatcattttatgttttagtcttatatatatgtccacagtccaccaattgtaccacatttaggctccacatagtgccatattttaggacagaagttgatgttcatatatagatgaaggttattaagtcgaggcctatctttaagacacattttccctttttgcttggtttttgtttaccactatatggtccccttttgcacttattgtttttttttttaagttccctttgaccttattgctaacggataccattgaatttaattgtaaataaatacattattcaatacagtttgaggcaggtgaagagttcctaaaaaaagttgccatgttaatgaaagacctgaaaatttatcacgatggctttgtgcaatttaattcaattttttccccatttttaatgtcctgatcgtgtagcatttacagtttttgtttcagtaggtgatctagatacctagaaactttaattagggcaagctttcactaatctaagaacagattgctgaacctatcttctgattattgtcgattttagatcctttaattggagctagctatgttttattgcttttgatttcttcagttcaaatcaaagatgaagctttttggttacaataatggggaagaaatcattgcaacccttgttggtaaaaagagtcgtatgacggaacgcaaaatcagcaaatattatctttaatttaatttattttttgaatgaaattttgaattgatacttgtaaaagacgaaataaaataaaccaatgaggtaaaatgaattaattttttttatcaaaattaaaattaacttgtatacttcaatttctttttaaaaaatcttatttattttctttttaaaatacttataaacttagaaattcagcattttggtcttaaaaaacttgtaacaagatattacaattgaaaagttcttattagttaagatgtttctaataaataattgtgaatgtatttatttcattatctaaattgcatttcttcactttagagaaatcttattttagagaaattaaatcctttttttcttagttcccatattatagcagccagtgacaaataaattgacataaaaattaaaaaagttaatcctactattattctaacaatgatacatatggcagaaaacatccccccccagaaatacacgatttcatctttatttttctccttatccatccgagtaatataatatttcaatcttattgttctttatcctttttctcttctctcattttttttatatgtccaaatccgaacagagtataaatgtaaatacctcatctaacaggaattagaatcacaattgctgtattttttggaatctcagtccccccgctccctgccagttttcatgaaaaattaacaatatattagtccaaaaatgacgtgctcaacaaaaacataactttaaatttcggcatatcacatgtttaatagtatatcatattttttttccaaataatttttgaatttggactgcaagtttcaaaaaagaatatattctctggaatctgtgatttttgttataacatcaactttgactgacctattaattttccttgcaaaattggctttttattagtgttccttgtctttggaacgtgtacagagtgagtcttttctttccttaattttttttttaaaaaaataaacacttaattttctccttcaaaaattagagtattgctatattattttccccaaaaatttggtaagttaaatatatattaaaaaataaaaataactaattttatgtcaccactttatacagaacaattcagtgacattttagattcataatatttgaaggattaacataatagcatactaatatttgtaagattaaaatgatgattctagctctattgattgaatgaaatatataagttgttgttataaattctaagtatttctcttctatttgtatggataaaaaatattataattattttattttattgaacaagaatacaagaaaatattcatttaatcaaagtgaaaaaaaatccttatatttcgtataagttaggaatacagatatgtagatgggtaaaattataatttaaaatgtaatatactacatataatattccacctaagtactattaaagagattggtatattaatgaacatttaagtaaaaacccaattttttaaataaaaaaattgatgtctcatcatatcatttaagtgagtttattgtcattcaaaaagtttaaagaagtattgtatagatcatacacaaaattaggtacatgcttaatcaaacagaatataactgaggtagataggaaggatacaaagtagatataagctgtccatataaaatagttgtcataatttattcttgactagtttcattaaggagtgatcctctccattttggttggcataataaagtgcaacctaagagagaacacttaatgaaatcctatattgaggaactttagataatgatattaaagatgagtgactccctaacggtcatttttggattagcatatttgacattcatttcttttcctaactatggcctttgaataacaatgaaggaaaagtaaccatgccatatgggaaagtttgtgtgaagctagaactcaggatcaatttggtttctgcagggccaatgtttcaatgaaaaacttcctaaattgatttgaagccacttctggagggtctaagactgcatgcattggatattggctaacatttgcatgctaagagacagatttgaaaaacagatgcatgaatttgcaattctgtaaatgtgggtttggttagatcaattatttaggagtggaagatgagtttcttttcatgttgcacatcacaagagaagatcgacaataactcattgaaaaggagcagtaagaactaccatcacgcaaaagctctgccatgtttagccaacatgtgttttaaatctggtattttttcctagctccaatgctaattttctcattgtatcaatttttcggccaacattttttcaatttaatgtctcatatctacagtttaatgttgtttccacgacaaattattttcctctagcacaatcttatttatctcaacatgaaatcctaaaattgaaatccatgaaaggtttataccatcacaataggcttcatcaactttttgattattatgaagcctcaacgatgtgaaatgcagaagtacatgcatatcttgtgcatctctttaggctcccttcctagtttaatgatgttcttagcttgttgataacatgttttgaaataatttgtgccaccaagttcttacagatcatgtaccaagtcttatcatttgacaacaggattcaaactcacatccttgtgagctatgagttttatccttaccaattagggtatcataaacctaaggatctcttactctctacctcaatagttgtgtctcaattgttaacatctagagttttgactttttacaatatattgctaagctaaaggtgcaaagtggtcttatagtgccctatatagtggatttcagctttctcagacattttttttctcaatgatgaatactgatgcttaaaacttgaacaaatttatcttgtagataccagcaaacggaagtacatagaagaagaaatagcaaaaattgggaaagggaatattacctctcagactttttcttatcacgagctatgtgttgcaactcggaactttcaccctgacaatatgattggtgaaggaggctttggaagggtgtacaaaggacgcctcaaaagcctaaatcaggtataacttcaactcgcatctatgtgaatattatgctaatatcatgctaagaaaaaacttctaaatgctgtgttcctttcatgcaggttgttgctgtgaagaaacttaataggaatggattccaaggaaacagggaatttcttgtagaggttttgattttgagtctcttgcaccaccctaaccttgtcaatttggtagggtattgcgcagatggtgatcaaaggattttggtatacgagtacatggtgaatggctctttagaagatcaccttcttggtaagtaaatgcttcttatgtcttctaatgcagtacatcacggataaaaatgagaggaacatccaatttgagtatcaaacttcaataaatgcaataaactaagtgtagtctgtagtggcagtgtgaccagatgagcacattggatcatcatggttattacttattagttacaacataaaacaatttgcatattgatggttttaagtagattatgttttatctttccatttgtgtgagaaaccaaatatatctgcaagactggcaccgtggaagttccccttttcaaaacattaccctagtattttttatttttttttgtgataagcatgctaaatgttatctgaccaacaagaaaagaaaaatgattgtcagaactacctccgaacagaaagcctttggattggcgtactagaatgaacattgcagcaggtgcagctaaaggacttgaatatttacatgaagtagcaaatccgcctgtgatataccgtgatttcaaagcatcaaacatactattagatgaaaacttcaacccaaagctctctgattttggacttgcaaagcttggtccaactggtgataaaactcatgtatccaccagggtgatgggaacttatggctactgtgcacctgagtatgcctcaacaggtcaattgactacaaaatcagatatatatagctttggagtagtgtttctagagatgatcacaggaagaagagcaattgatcagtcaagaccatctgaagagcaaaacttggtcacttgggtatgtcatgaagcttttattatgtgcctagaatcatatttctctggcctaaaatttcaggatttataatctaatcaagggcaaaatgtatcacaagtcccttcatttttggtcaaaattggttttagtccccatattttaaaaataataattttgttcatcgtattttttgtaattggtgaatttcgtctctgaccctagtatcatatgttacattaagagagatgactataaaaaataaaatcatggtttttaaaatatagataccaagattaactttgactgaaaattgagggacctaaaacactttttaccctctaatcaatatgaaaactagtccaaaaatttaagcttagaccattaatatgcacaaatgttcagcaattgacattcataatgtttcttgttttcaggcacaaccactattcaaagaccgaaggaaattttcatcaatggctgatccattgctgaaagggaactacccaacaaagggtctacaccaagcaatagcagttgcagcaatgtgtattcaggaggaagcagatacccgacctttgattagtgacgtagttacagctcttgatgttttagcaaagaggcatatacaagtgggaagacaacaacgttcaaaagagacttttttcgagcatggggaatgtagttgacaaaacgaacctgaaaacagtagaggattacagaaaaggacaatgaatgaaaaagcagctgctaatgaagtttgagaatcattctataaaatttcttaatgatgccacttggtatccttatgaaaatcgatcaaaacggttacatatttttgcatgttcacgatttattgagtagtagtattagataatagatattgataatagaatgacaagattgttaccagattcataattgcctactcttcgagattctctaatcaatactgttacaacgtttcctttttgtttcagctttcataatggaaaataccacactcgacaaaacatttgactccatatatcttgtgttgttgatcataaaaccaaagcagtgaggtcaatgcaattcctttcctccttaaactggcttatctagagtaaaatggtttcatgaagagtgttctggtctttcagatgataatgaaaaatggtttccagttcaaagtggaaacctccttttggtttgacagaaagaacattatcatccatcattagtggcagaaataaacttgcacttaacataaactttagtctatcttcacaaaataaagatatatatttgctaataaggaagcaattcatcttgtacacatggaaaagtcgctgaagaaatgtcttcaaattaaccataataaattacattgctctctttggtcccactttcaaaaaaaagaaaatctacgttctcatcctttaaattgcctctctcaattgcacataaacacttgtaatgtctgaaaattcacccatttcaggatacagtgtaatcaagggttgaatgaagatggcctagggctctatgatgctctcataatagattacttagataatttaatattaaaaagaaaatttcagtaaattttatattatttagtttgttttatttatttccatcaaataatatataagataaaaaaattatctagtaacttgacttgtgttgttcttatgttgtatccattaaaagcaccctaagtgaaaaataattgttacaataaagtaataaaatgtacaattaaacaaaaaagtattaaatgagttttataagttttcctacattcgtatattttatctatttttatgtcaaaattcttaacattgagacaatgaaaaatattttgaaaatttagcaatttattttaacttgtcttttaatgaaataatttattgaaaaacataatcaattctttcaattaaattttattaaaaattgcaaaaataaacattgcataaacaaaacaacattgaaaataaataatatagattacacaagtaggttacataattcaatatttttctcaaattatgttatatagtatcttataatctttatattatttcttcagatgtatttataaatttataaaaaggacctccaatttttgttttaacttcaagccttttttcttaacagcacttcaagactttaaccatccaatttttatttgcacgcttcattatcgtattttttaaaaaaattttgtacattttaccaattcagtgaataaagtgttgatctgtcccaaaaaaattataatttttttattacttttttgtggaaaatgacgtcattttgttaaaaatataatgataaaatgtggaaaaaaacatgaatagtaaaatacgtgaaaattgaagataagatgataaaatgattaaaaaaaataggcgataaaatttacaaaataataacagttaggtttgtaaattatgcaattaagcattaaaaataaaagaaggttatttgataacaaaatgacattgttccatttttttcactatttttagggatttattagtatgtgattacatatttattataattttatgtttgtaatgaataaaaaaaataaaaattaaattatattttaggtaaaatagtgataaattcatctctaattatttaaagtgttgacaatttcgttttttagtgtgtaaagcgcaacaaattcgtccatgaatatatcatctagactctttcattaacgataatgaatgaaattaatggattgatgcatttttttaactttcaagaaatttttttaaaattttgatatattagaaatgaatttatcaatatcatataaatttcaaaataaaaatgagtatttattcataattttatgttaaaagcacaccaaacagcacctaagactcctatttatgcctccgccgaccgagagggcatcctagccttccaatcataagattacgtggcaattaaatattataacaccttatttttatttggggttttattttatacgtattttatattaatggccaaggtttttcaaatattttgctccttttttatatatatatatatatatatatatatatatatgtatgtatgtatgtatatttttatatattatatattcaagtagctggctcctaatctgtttaactgtggagggagcaggagcactcggaggtgatttctgcctcaatggaggtctctgctttaaggccacactgccctttatgccgccgctgcttctcaagtcccttctctcttccttcccttttaccttctcagcctctgcagcggtttaccctttttcctttatctttttttcacttcaaatttcatgtcttttgttgcttctgacctcgcccatctctttaatatccttaaattttgcatcttttccaactgggtattctgcttttagcttaagaaattaacgtttttatgttacacagtaaaatatgctgattgttgtttttttgtctttacttcaatgggtcagtgtgccttgttgttcttcactggtttgaaaggttgtgactggtattaacattaagtcaagtgtgacttttcaaattttacttgtattgtaactgctgtgacaatttgttgatgataaaacctgaaataggttaatattaaggattctatccggggattaacttttgttagtaaatgtgggaatagagtgatgaagagatatattttctctttgtaccacacatgcctacagatgaagctttttcttagcttgtggatggctacatttcattgattggaacctttatttttgttgcatgatgtgaattgcagaagaaaaatgcagtcattccaaatttccctccgaaatagcgctgtgcttagaaattatgtactatgtagagcagatttctcatgctgtctaaaggggatatctgcggggttaaataaatacaatggcgtgaggtgtaagcgtaattttctgtgcaagagtccagtttgcatttcatctatgaaaacttcaaatgcatcaactagcacgttggaggaaatgactgaggaggaagagctgaactctttgcattcatgtgaagcccaagttaggacgatgggcatggcttcttgcaacaatgaattttccgaaaccacttcaggaaaaaaattgtctggtggtgattatagaggctggactatagcaaaagataagttaactgaaaataaaaaggaaatgaacggctcaaataaatttgagagtgaaaatggcagttttagtgcatctaatggagttgcttccattgatcagaaccaggctgttccaaagaacggggatagcaatattgtactgcaggattctggtgcacatgtcccatcttctgttaactattctgtattaaacaattcaaaggtgttaatggattctgaaagggtgattcaccagtataacggatcttcattggggattggtaaagaaaaagtccctgtagtcaatggtgatcatggtttggatggaactgcaaaggattcaactaatgtaacacttactaaccaggcatgtggtactgaccaatcaaagctcctggataggctttgtagtatatatgatgatattctggttgttgataatattcctcttgcagaggaagttgctaagatgcttacaacaaagttccagcatcttatttatgcatgtgataccgaggtataattctttttactgtatttacttgtattatggttactccatatcacaagattatctcctttgttgcttctgtgcacgtgtgtttgtttgtgtactttggacatgaattcaactaatttttatttgtgtaacacattatctgctgattttattgtcttcaaaggtagccaagatagatgtcaaacaagaaactcctgtagatcatggggagataacatgcttcagcatttattgtggtccagaagctgattttggaggtggaaagtcctgtatctgggtagatgttcttgatggtggaggcaaagagattttagaaaaatttgctgaattttttagcgattcttccatcaagaaggtgaacttttcttcttctatcccttctatgttcttaatcctattactctcctcaacatgcaacacttctcaaatattagttctatgcttgctactttatgaaatatgccttcctagttaagataaatgacaatcagctacaatctgttctgaaattaacctcaggtaatctaaaagtttagtgtcatattatacagagagctttatcgatttttactgtgtgttctgtggtatattcaatttttcaataatatgctaagaataggttgcaacttgcattcctaatgttaagttaatgtgtacctgatttaggatagttggtgcatggttttattgtatagaacagagaagttttcatcttatgatagaagtgaactagcatgatttgttattctattttattttatttgtgtagttgttagatattcttatcttgtagtaatagaaaattaaatctatcttttataaaatcatattggcattaaattcctgggtttgtctatgctcgtgaccagagattacaaaccatatttgaaataaccgagtcactggtgcattctgtaggtctggcataattatagctttgactgtcatgttatagagaattatggattcaaagtttcgggatttcatgctgatacaatgcacatggcacgattatgggattcttcaagacatttggatgggggttattctcttgaaggacttacaggtgacagaagggtcatgtctagggctcagctgaaccatgaaaaggacttgattggtaaggtgtcaatgaaaactatatttagtaagaaaaaattgaaaaaggatggatctgagggtaaaacaagtatcattgctcctgttgaagagctacagagagatgagcgtataccttggatatgttattctgccttagatgctagcagcactttgaagctgtatgagagcctaaagagccatctttcagacatgccctggaaatttgatggtgtgccagtttatgggaaaaccatgtatgatttctacaatgaatattggcgtccatttggtgagcttctagtcatgatggaatctgagggaatgctagttgaccgggcttatcttgaatgcatagaaaaggtggccaaagcagagcaagaggtagctgttaatagattccgcaaatgggccactaggtattgtcctgatgcccagtatatgaatgtgggaagtgattcgcagttgcgccagcttctttttggtggcattgtgaacaggtgcacatttttaaaatcttacgtgtagcatttatttcaatcttaaattaatgatttgctagtcaaagcctgaaatatttatgatattcataagtttaatgtattcactattcatgaatgatggtactactactggtacctaccttgatatttatgaacttttctgtttacaacaaagtagctgaaggatatagatggaagtaaaattttcatttcacttgtcacatgcttcattacagaaaggactccaatcagacgcttccaactgaacggatattcaaaattcccaatgttgataatgtgattgaagaaggtaagaaggctccaaaaaaatttcgtgatataaagttgacgagcctaggttataacctggagactgagatgtacacagcaactggttggccgtcagttagtggtgatgctttaaaggctctggctggaagtatttccgctgattatgacttttttgatgaggattgtaacttggatcttgatgatgaagatgaaaatccttctcaaagtcaagttgcaccggtaaaaattgataaatctgcatatggcacagcctatgcagcttttccaacagagaaagaagggagagaagcttgccatgcaattgctgctttatgtcaagtctgttcaatcaactctttgatctccaacttcatccttcccctgcaggtatttttttattgtttggtttgcaatatgaactttcttgagcttgcttggaatttcttttattttgaaactagtatacaaacttccatactgttcatattgtccgtaataaattgatgatatttttctattttttccctagaaaggatatttttagacaattataattattatataaacatcagtcaatgagatgcttgacaactcacctgtgcaccaaactcacaagtaccacagtaccttgagcttttaaaatactcattggagatggtcaatactaagttctcccactgcttagctatggctagggaaatcatttccttatctgagtttaagctaattttttgaatgcttattgtgccaccacttacattttagaacttttagtaaatatttgtattcttacactgaagctctttatatgtgctctataatagctgcagtttctctttgtcagggacataatatatcaggaaacgatcttcgtgttcattgttccttaaatatcaacacagagacaggacgcttgtcagcaagaaggccaaatctgcaggttattctaattagattaatcagaattctctaatggttttgattaggaattttcattttaatagtagttgttgtgaacttcaaatttttttaagtgctatacatttgagatctgaccattaaccttcatctgtgtgcttgtatgttcactaattggtgtcatacagtttccttgatgctaaactcttagtagatggctttatcattttgtcttttaacctaaaatgtagtttctccttttagtagggtttcttcctattagacatataagtccattttggacctccactctatctttttgctgctgtttttcttaattaaattttggcagtaaggttgaacaaaaaataaaattcagcagaaggtgaaataggtctgtggattatatgtgtttcaaacctgaattattcttgtgtgaggtagcgtgttaaaaatataaaaccctttttaggccgtcatctatcaaatatctcgaggtcaagagtcagttcttgacatctctgctcaaattacattcttttgtattcatttattacttcagttaaaaatatcttattaaaattagtgtttttggactaatcacagccttgctaattgcaatacacatttatgtaatcatttgatgtctacttggtcttgatgccttttctgttactttattacaatgatttggatcctaaatttggactgcacaatgcatctcattcattttcaatttgtattttgacattgacatgtgggtattacatctactagattaatcagaatttcaaaacaatatagaacctaacacatacacttcatgaattagaatcaacctgctctggaaaaggaccgatacaaaatccgtcaagcattcattgctgcacccaggaattctcttatagttgctgattatggacaggttaacagtctatattgtctatctaactgaactattttcaagaaatttcattctgttaactgccttgtttattgttacagctggaacttaggattctggcacaccttgcagactgtaagagcatgttggaagcttttgaagctggtggagatttccattcaaggactgcaatgaatatgtacccacatattcgtaaagcagttgagaaaaaggaagtgcttcttgagtggcatcctcagcctggtgaagataaacccccagttcctcttttgaaggtaactgtccgctgatagaagtaccatttcattgagatgtggaagtagtggctttgtctttagtttggtatttcttgtagctgatgacgtcaaatatagtgaccaccagagtgctggcagatgcatgagggaggactaatccttattctgattggaccgagatccatcaacggcaaatagaataaatataatttattaaaaatcagaacaaatacaaataacttgtgaactttccaatagaaataaaggacagctactgatcattagaacactgtttagggggaaaacatagttgcagtggtagtagaagaattcactgagttttttgatatataatgtgtttaatgatgtttatgtatattaatagaagtaaatcagaatacaccaggcattaataagcttttttagtagtttaacgttatttgatgcccttccctcaagatataaaaaagttgttttagcattttactgttataacttataaccatctaattcatgattgatcatgttttgatttttgttttccttccatgtcaggatgcctttacttctgaaagaagaaaagctaaaatgcttaacttctcaattgcatatgggaagactcctgtggggctttccaaggattggaaggtaccctgaacttttacttattatgagggatttacaaaggtgaaaagtgcccttgatttattatttgattgttcactctcaggtttctgtgaaagaagctaagaaaacagttgacctttggtacaatgatagaaaagaggttttgcaatggcaagaggagcgtaaaaaggaagctcgcgtgttacattgtgtttacacattgctagggagagctcgacggttccctttgatggcccaagctaacacctatcagaaaggtcacattgagcgagctgctattaatactccagtgcaggtccttagctctttctaataaacaaatcaatactgtgtctccctcactcatctatctaactgtctttgcacactctagtaaataaaaaatgtactgaattatttatcttgtgattcttgtctagtttggaacttttcccttttaagaacaatgaatgatgagatcacattttgagagcccacttgtaaaatatcatattccatagtttatattgaaatgatagtccagatagagctgtgaataagaatagagtttgattgtattaacattacaatagtgtcatcttgtattagtctagttagtactgttccctatcaggaatctccttttttgaaatccattattgggtgaaattatatttcctttacatatatttgatagagtgctaattctactctaccactactcctaagaaaacaccattaaagctacaaataaaagctataaagaagataaacataaaattcagatttcattcattgataataataagtaaagatgagtacatttatgtagtcctaaaaatgtcaatcaaggataataattatccaagtgtcaacatcatattattctaacacaaattaaaaaaaaaactataattataaaatacatatttaactccatcctatataatccttggaccatttaattttgggcctagagcccatcctatcattacccaccggttcacattcaaccttgtcctcaaggtttgaaaacaactggaattgagagcaacagcttgttgcaaatgatgagtatgttgcttttgggggcaagaaaataattgtggatgggttttggaaattggtggcagtacatgaaaaaagaaaaggcttatgagacttgttttgatccagtggttggaagggaaatataactttatgagaaagtgcactatgtgggataagggagacacgtggatggtgttgatggttgttaggattttgaaaaaatttggtaagtggagatggtttagggaggatgtacatggcatggttggggtgggattttaacggcttagatgtgtggtaattggatcgttggagatctaagggatggtgatgcaattgagagagtgggagccagctgtgatgtgggagtgcacatgggtgaaaggacacatggtgatctagatgttttattttctaatatgatggacgggtgtgattggggaaggaggttaggttcaattgcaatgagattggatcggtgcggctgggaaatttcccaagcgcaaaacattggttgccttttggtggtgtattgtgattgtggatttggagtgaacggtgaaggggattgtgggtggtgggttggggttgcaaaaattgaaaaggttgatgtggggaaaatagattttgttgcaacacccagcaagtgggtaaggtgatacagagatgcggttggggttggggttggggaaaatgttcatgagtggaacggttgtatgggaaatattgttaaagcaagggtacggagaggagaaactttgttgtggtggaaacagtggcgactgttgcggcggtggttgcgacggcggcgacagtggcggcgattgcggcagtggttgtggtgtctgatgttgaagattgagagcagagagttgcttcatcatgctatgcacggtggaggtgaaagtgtcatgaaaggaatcctgggaccttagatgggtagtgtgctgagatattttattttcttcatagtggttgagttggttctggaaggcatctaatttcggaaaataccttaaaggttgtcttccatggtggttgtggtggatttgggagggggagtaagatgatgaaagcaccattggatagagtgctaattctactctaccactactcctaagaaaacaccattaaacctacaaataaaagctataaagaagaatcataaaattcagatttcattcattgatagtaagtaaagatgagtacatttatatagtccaaaaaatgtgtctttacctaacaacttatagcttttgggattggtttattacaatgcccatagaatttgtaatatattccattagtttgtaaatgtaaagataaatataaatatattattactgaaaatataagaaattatttactattt

(The sequence listing continues in the following parts.)

---

What is claimed is:

1. A nucleic acid molecule comprising a polynucleotide operably linked to a heterologous promoter, wherein said polynucleotide encodes a polypeptide having at least 95% sequence identity to the full length of SEQ ID NO: 11, wherein co-expression of said polypeptide with a polypeptide having at least 90% sequence identity to the full length of SEQ ID NO: 16, in a soybean plant, enhances resistance of the plant to Asian Soybean Rust (ASR) compared to a control plant.

2. The nucleic acid molecule of claim 1, wherein the polynucleotide comprises:

(a) the nucleotide sequence of any one of SEQ ID NOs: 7, or 8; or (b) a nucleotide sequence having at least 90% sequence identity to the full length of any one of SEQ ID NOS: 7, or 8.

3. The nucleic acid molecule of claim 1, wherein the heterologous promoter is a plant expressible promoter.

4. The nucleic acid molecule of claim 3, wherein the heterologous promoter comprises SEQ ID NO: 9.

5. A vector comprising the nucleic acid molecule of claim 1.

6. A transgenic cell comprising the nucleic acid molecule of claim 1.

7. A method of producing a transgenic soybean plant with increased resistance to a soybean pathogen, the method comprising:

introducing into the genome of a soybean plant, a nucleic acid molecule comprising a first expression cassette comprising a first polynucleotide encoding a polypeptide having at least 95% sequence identity to the full length of SEQ ID NO: 11 operably coupled to a first heterologous, plant active promoter, and a second expression cassette comprising a second polynucleotide encoding a polypeptide having at least 95% sequence identity to the full length of SEQ ID NO: 16 operably coupled to a second heterologous, plant active promoter, wherein the polypeptide having at least 95% sequence identity to the full length of SEQ ID NO: 11 is co-expressed with the polypeptide having at least 95% sequence identity to the full length of SEQ ID NO: 16 in the plant, thereby producing a transgenic soybean plant with increased resistance to a soybean pathogen, wherein the soybean pathogen is Asian Soy Rust.

8. The method according to claim 7, wherein the introducing step comprises:

(i) transforming a soybean plant cell with the nucleic acid molecule, thereby incorporating said nucleic acid molecule into the genome of the soybean plant cell, and regenerating a transgenic soybean plant from the transformed soybean plant cell; or (ii) crossing a first soybean plant comprising the nucleic acid molecule with a second, different soybean plant.

9. The method according to claim 8, wherein the method further comprises obtaining a progeny soybean plant for one or more generations from the transgenic soybean plant, wherein the progeny soybean plant comprises the nucleic acid molecule in the genome of the plant and has increased resistance to the soybean pathogen.

10. A transgenic soybean plant comprising in its genome a first expression cassette comprising a polynucleotide encoding a protein having at least 95% sequence identity to the full length of SEQ ID NO: 11 operably coupled to a first heterologous plant expressible promoter, and a second expression cassette comprising a polynucleotide encoding a protein having at least 95% sequence identity to the full length of SEQ ID NO: 16 operably coupled to a second heterologous plant expressible promoter, wherein said transgenic soybean plant has increased pathogen resistance to Asian Soy Rust (ASR) relative to a soybean plant not comprising the first and second expression cassette.

11. The transgenic soybean plant of claim 10, wherein the soybean plant further has increased resistance to any one of the following: soy cyst nematode, bacterial pustule, root knot nematode, frog eye leaf spot, phytopthora, brown stem rot, nematode, smut, *Golovinomyces cichoracearum, Erysiphe cichoracearum, Blumeria graminis, Podosphaera xanthii, Sphaerotheca fuliginea, Pythium ultimum, Uncinula necator, Mycosphaerella pinodes, Magnaporthe grisea, Bipolaris oryzae, Magnaporthe grisea, Rhizoctonia solani, Phytophthora sojae, Schizaphis graminum, Bemisia tabaci, Rhopalosiphum maidis, Deroceras reticulatum, Diatraea saccharalis, Schizaphis graminum* or *Myzus persicae*.

12. A nucleic acid molecule comprising a polynucleotide operably linked to a heterologous promoter, wherein said polynucleotide encodes a polypeptide having at least 95% sequence identity to the full length of SEQ ID NO: 16, wherein co-expression of said polypeptide, with a polypeptide having at least 95% sequence identity to the full length of SEQ ID NO: 11, in a soybean plant, enhances resistance of the plant to Asian Soybean Rust (ASR) compared to a control plant.

13. The nucleic acid molecule of claim 12, wherein the polynucleotide comprises:
(i) the nucleotide sequence of any one of SEQ ID NOs: 12-13; or
(ii) a nucleotide sequence having at least 90% sequence identity to the full length of any one of SEQ ID NOs: 12-13.

14. A vector comprising the nucleic acid molecule of claim 12.

15. The nucleic acid molecule of claim 1, wherein said polynucleotide encodes a polypeptide having at least 98% sequence identity to the full length of SEQ ID NO: 11.

16. The nucleic acid molecule of claim 1, wherein said polynucleotide encodes a polypeptide having at least 99% sequence identity to the full length of SEQ ID NO: 11.

17. The nucleic acid molecule of claim 16, wherein said polynucleotide encodes a polypeptide comprising SEQ ID NO:11.

18. The nucleic acid molecule of claim 12, wherein said polynucleotide encodes a polypeptide having at least 98% sequence identity to the full length of SEQ ID NO: 16.

19. The nucleic acid molecule of claim 12, wherein said polynucleotide encodes a polypeptide having at least 99% sequence identity to the full length of SEQ ID NO: 16.

20. The nucleic acid molecule of claim 19, wherein said polynucleotide encodes a polypeptide comprising SEQ ID NO: 16.

21. The transgenic soybean plant of claim 10, wherein the polynucleotide in the first expression cassette encodes a protein having at least 98% sequence identity to the full length of SEQ ID NO: 11, and the polynucleotide in the second expression cassette encodes a protein having at least 98% sequence identity to the full length of a SEQ ID NO: 16.

22. The transgenic soybean plant of claim 21, wherein the polynucleotide in the first expression cassette encodes a protein comprising SEQ ID NO: 11, and the polynucleotide in the second expression cassette encodes a protein comprising SEQ ID NO: 16.

23. The transgenic soybean plant of claim 10, wherein the polynucleotide in the first expression cassette comprises SEQ ID NO: 7 or 8, and the polynucleotide in the second expression cassette comprises SEQ ID NO: 12 or 13.

24. The transgenic soybean plant of claim 10, wherein the plant is an elite soybean plant.

25. A seed of a transgenic soybean plant having increased resistance to Asian Soy Rust, wherein the seed comprises, in its genome, a first expression cassette comprising a polynucleotide encoding a protein having at least 95% sequence identity to the full length of SEQ ID NO: 11 operably coupled to a first heterologous plant expressible promoter, and a second expression cassette comprising a polynucleotide encoding a protein having at least 95% sequence identity to the full length of SEQ ID NO: 16 operably coupled to a second heterologous plant expressible promoter.

26. The seed of claim 25, wherein the polynucleotide in the first expression cassette encodes a protein having at least 98% sequence identity to the full length of SEQ ID NO: 11, and the polynucleotide in the second expression cassette encodes a protein having at least 98% sequence identity to the full length of SEQ ID NO: 16.

27. The seed of claim 26, wherein the polynucleotide in the first expression cassette encodes a protein comprising SEQ ID NO: 11, and the polynucleotide in the second expression cassette encodes a protein comprising SEQ ID NO: 16.

28. The seed of claim 25, wherein the polynucleotide in the first expression cassette comprises SEQ ID NO: 7 or 8, and the polynucleotide in the second expression cassette comprises SEQ ID NO: 12 or 13.

29. The seed of claim 25, wherein the transgenic soybean plant is an elite soybean plant.

30. The method of claim 7, wherein the polynucleotide in the first expression cassette encodes a polypeptide having at least 98% sequence identity to the full length of SEQ ID NO: 11, and the polynucleotide in the second expression cassette encodes a polypeptide having at least 98% sequence identity to the full length of SEQ ID NO: 16.

31. The method of claim 30, wherein the polynucleotide in the first expression cassette encodes a polypeptide having at least 99% sequence identity to the full length of SEQ ID NO: 11, and the polynucleotide in the second expression cassette encodes a polypeptide having at least 99% sequence identity to the full length of SEQ ID NO: 16.

32. The method of claim 30, wherein the polynucleotide in the first expression cassette encodes a polypeptide comprising SEQ ID NO: 11, and the polynucleotide in the second expression cassette encodes a polypeptide comprising SEQ ID NO: 16.

33. The nucleic acid molecule of claim 3, wherein the heterologous promoter comprises SEQ ID NO: 14.

34. The nucleic acid molecule of claim 3, wherein the heterologous promoter comprises SEQ ID NO: 19.

35. The nucleic acid molecule of claim 3, wherein the heterologous promoter comprises SEQ ID. NO: 20.

36. The nucleic acid molecule of claim 3, wherein the heterologous promoter comprises SEQ ID NO: 21.

37. The nucleic acid molecule of claim 3, wherein the heterologous promoter comprises SEQ ID NO: 22.

* * * * *